United States Patent 12,553,090 (MOLECULAR PREDICTORS OF PATIENT RESPONSE TO RADIOTHERAPY TREATMENT) - sequence listing, part 5

SEQ ID NO: 187 - DNA, 18946 bp, Homo Sapiens
gattggcccctgggccaggggcggggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggcaagagatgaaataaatttattcttttatacaaccagtaaactgtgctaggtgcccaaacgtgaggaactgcagctgaccttacaatgaacaaaatacaaaaactgtccttcatggagcttacattctagttgaggagtgagtgaagtcttgaggactcccagaaagagaaatgttttgagtgcaccttgcatctgtacttgggtgtctcaaggcaccttaaactcaacacgatcatttcctggaaacccagtcctcctccagcacttctagcatggtgccggcaaagcagacattcagagaatgatgaccagatgttccacaaggaagtaactagcacgactctccatccagtggcacaaagcgactcttcccctttccttgactctacatctaatttatttggaaagcatgtcaagcttaccttcttaatccttctctggagtctatcctattcacattgcttctaccagctgcctgatctgtgttaccatgagtcctctcttgaacaatggtctgctaaattggtttcccatttccagtcttgactccctacaagtgaggcttcacatcacattctgagtgatcttttcaaaactcaaatctggctgtgtcttacacagatatacgtgaacacccttttttttttttttttttttgacggagtctcactctgtcacccaggctgaagtgcagtgatgccatcttggctcaccacagcctctacctcccaggttcaagagattctcttgcctcaacctcccgagtagcctcagcctcccaagtagctgggattacttgtgcccgccaccatgcctggctaatttttgtatttttagtagagacggggtttcgccatgttggccaggctggtctcaaactgctgacctcaggtgatccacccgccttggtctcccaaagtgctgagattacaggtatgagccatccgcacccagccatgaacacccctaatgaaagccctttaataatttcttatttcttctagtgtgaagaccagaatccttaacatggcctgaaaggcccagcctggtttggccctttctcactctctgggtcctggctgcactaacattctttgaattctctctgcttctttacaatacaggaactttatacattgttctttctttgtacattgagtatacttttcattcattcatttccactcatctggttaattcctacttgtccttcagctctcagctccttcaagtcttccctagggaaatgttccaatcatcccacttaagtcagattgctgtcatattataggctttcctatatttgttctcttctgcagttcttaatcacagttgtaattttacatttatctgtgtgattatttgttgaatgtcttttaagctctgtgagtgtaaggaagtatcaattttgctcactattgtacctgtagagcctaacatgcctggcatattgcatgtggtcagtaactattactgaataataagtagatcattgagttctggccaatgagatctcctcaggctttagatgagactcttggaattggatgaaggatagggaaagaataataggatctgttgttttagaaggatcatttatgagtttcagccgggtgtggtggctcacgcctgtaatcccagcactttgggaggccaaggtgggctgatcacttgaggcgaggagtttgagaccaggctggccaatatggtgaaaccccgtctctactaaaaatataaaaattagccgggcgtggtagcacacgcctgtaattccagctacctaggagggtgaggcacaagaatcgcttgaacctgggaggtggaggttgcagtgagccgagatcacgccactgctctccagcctgggcaacagagcgagactctgtctcaaaaaaaaaaaaaaaaaaaaagaaggatcatttatgagtttgaaccatgttcttaggttgaaaaacatctatattgcttactagatctttccctgctttgctctcaagagtaattcttcccagcactttgggaggcaaaggcaggaggattgcttaagcccaggagttcaagaccaacctgggcaacataaggagacccaatctctacaaagaattttaaaattagccaggcatccaggcacagtggctgacgcctgtaatcccaacactttgggaggctgaggcgggtggatcgcgaggacaggaaatcaagaccagcctggctaacatggtgaaacgccatctctactaaaatccaaaaaaaaaaaaaaaaaaaaagccaggcatggtggcacacacctgtagtcccagctacacaggaggctaaggcaggaggatcacttgaacccaggaggtcaaggtggcagtaagcagtgatcacaccactgcactccaacctgggtaacagagcaagaccctatctcaaaaaagaaaaaaaaaaaaaaagtgggtattttcagcattttctggcaaaagtgggaaaatattgggtcctgaaatgtatatggaactattttttacaggtgatcataaggtccacagattattagatggcatgtcaaaaaatccttcagggaaaaacagagaaactgttccaattaaagataatttcgaattagaggtacttcaggcacaatacaaagaacttaaagaaaaggtaagtgacttaacttgtggtttttgtagctaattcattcacttacgtgtttaaaagcattgtacagtaaaatatacaaaagttgtaaaacaagtgtctagattcatccctatgacatgggaaaagactagggaaagaaaaccagaaagtttaggctgaaagaaactaaattgtgagattcctaatgccaaaggcaagaagaaaaacactgtataccagatccaaaaagagatacaaactgttagggtactaagatgaatttatagcatgtatcttcatgtgaataatacaacttcataatggttgctattttcattagcagctttgcaagaaagcagacacttcatatcaccatctgtaggtccctaagaaaaccaggaatatgtggaattttagttgtgcaaggtatgtgacccagattttttttttttttttttttggagatggagtctgtcatccaggctggagtacagtgacacaatcttggctcacttcaacctctgcctcctggttttaagcgattcacatgccttagcttccagagtagctgggactacaggtgtgcaccacgacgcccagctaattcttgtatttttagtagagacggagtttcaccatgttggccaggctggtctcaaactcctggcctcagcctcccaaagtgttgggattacaggcatgagctaccacacccagcgacccagatcgttaatgcctcttagagcctaaagaatccggccaggcgcggtggctcacacctgtaatcccagcactttggtaggccgaggccagtggatcacctgaggtcaggagttcaagaccagcctggccaacatggtgaaaacccgtctctactaaaaatacaaaaattagctaggcatggtggcgggcacctgtaatctcagctactcgggaggctgaggcaggagaattgctggaacctgggaggtgaaggttgcagtgagccgagatcgtgccattgcactccagcctaggcgacaatagcaagactccgtctcaaaaaaaaaaaggaatctggtcaggcaaggtggctcatgcctgtaatcccagcactttgggaggccaaggtgagagaatcgcttgaacccaagagttcaagaccagcctgggcaatacaatgagaccctgtctctacagataaaagtgaaaattggccaggctagtggcacatgctttgtagtcctagctactcaagaggttgaggcgagaggatcacttgagcccaggagttcaaggttacattgagctatgattgtgccacagcattccagcctaagcaaccccatccccctccctggcaaaaagaatctgcatgcatgagtggcaagtgtatgcttaagctatcttgatgaatatcagctgtcccatgaacaggcctagcagaccatggtgacatctggttgctgtggatatattttgagtactcatttgtctgtttttcctgtgctttctccatctccccaactacatgttaaaacaaagtacctaagtagttttctcttacaaagttttcacgagattaatttgggatttacagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaaggtgacccagagcatttgttttgcaccagctttgcctgcccactgagttcctttgaccagggttgcctgtaaatcttccagggagatttcaacacttgtttgtcttaaatactttctgctatcatctcattgccatccactcttcttccagggtctggatatattttggaaagggatttagatgaaactctattttgctgtggtagttggtcttggcaggagtaaataactagcttagcatttctagaaacaggtttacattaaggctcttttgctagatcagaaactcaactgacctggcttaggctaaaaggaaacgtattggcttccatatccaagtctgggaagaaccggggtatgctgggaccttaaatgacttaaatcttgccaggacatttttattctctatgctataaacaggctctatacttatggtagagggtgtgttctccagaagctcctgggctcatattttataaatacagagcagaattaagacttagggccacatgcagtggctcacacctataatccagcactttgggaggctgaggtgagaggattacttgagccaggagttcgagaccagcctgggcaactagtgagacctcatctccacaaaaaagaaaaagaaaaaatgaacaaaattatccaggcatggtggtgtgcacctgtagtcccagctactcaggaggctgaggtgggagaattgcttgagcccaggaggttgaggctgcagtaagccatgatcatgccattgtactccagcctgggcaatagagcgagaccctgtttcaaaaaaagacttaggctccctcatctcaagttttaaaattctgagaaaggctctgattggtttaacttgagtcagttgtctgtccctggccaattgctataaccaaaagcaaccaaaagcaaaaaaatgacagctcccattctaataaaatagtcagaggtagggaaattattgaatttttttttttttttttttttttttgagacagggtccagggtttcactctcttgcccaggctggagtgcagtggtgcaatcacagctcactgcagccttgacctcccaggctcaagcaatcctcccatctcagcctcccaggtagctggaactataggcacacaccaccaggcaaagctaatttttaaattttggtacagacagggttttgctgtattctccaagccgttctcaagctcctgggctcatgcagtcctcccaccttggccttccaaagtgctgagattacaggcgtgagccacaatgcccagcctgtttctcagggaaaggaaaatgctattctggaaggaaaaacagtaggtatccagtacctactacaactttccctcagcacctcctcatgcttcaatctcaaggacatgggatcttattctcattgtttcattcagcaaacttagcaaactttaagcacttacctgtgcccatcattaaccgcaatagttaactttctgtataagtgatgaagagcaaggaatttgcggtcagacaaacctgaatttgaatccaggcttcatcacacataagcagtgacctcaaggtaataacttaagctccctggctcatttcccttatctgttccaagacataaccagaaaggttgttgggagactcacacattcttgcacttactgtgtctggtgctgggcctggcgcagagtgtgcttggggaatgatggcagttactgttggctgtagcaactgcaggccagagcagcaggtctctctatactgcacagtgtcttggtaaactattccaactactctgcccaaactttgaggaagacctggaattgtgcaccagtgcgttcgttaataaaggtcaatatgttactgctgacatagggcaccttaccaagctctatgctgggtattttacactcatcattctacttaatcctcccaactatcatgaagacaggtgttttatgttacaaataagttaggattcaaagacattaaataaatggtgggctggtatttaattcttttttttattttttaaattttttgtagaggcaagatcttgctattttgcccaggctggtctcgaactcctgggctcaaatgatcctcccgcctcaacctcccaaagtgcttaggattacaggcctgaaccaccacacccggccagggctggtatttaaaccctcacaaactacccttacaatagagtccagtatctttttagagtaccatattgtctttcagaaagaaagctaatgtttaatattttaggacatttatgtcacagcagactttcatatgtatttttcattgtttgtcttttactggcttgtgattttgaagcccagagatatttttgtgtatatgatgggaccactacaagcatgtttcttttgccttccagctccaatcattgcagtctgaactccagtttaaagatgcagagatgaatgaattaaggacaaagctccagaccagtgaacgagcaaataaactggctgctccctctgtttcccatgtcaggtaatgatggtgctggagggatagttcagttttgcattatttagtaaaaaatctgcataacagtgtcaggctggtcctaaatgaaggccatttagacccctccacctgggcagagatcctcttttcctgaaggattcagaggtggtttagatgaagcttgcatggtttgagacatcacagcataaaggcctatactctagaaatgctgcctctgtatggcactttataaacataattcttcaggactagaaagacctggaaaaatgatctccaaattttgggggtgggctagtctctacttttatgtaatttgtttaactgattttgttgcaagcatgggtgtattttagttccagctacttggaatatttttttctcatttgctttctggggacccttgtccaacagccccatcctttgtggtcagatgtgctcaacttgttttttttttcttttttttttgagacagagtctcgctctgtcacccaggctggagtacagtggtacaatctcggctcactgcaacctccgcctcctgggttcaagcaattctcctccttcagcctcctgagtagctgggactacaggcacacaccaccacgcccagctaatttttgtatttttagtagagacggagtttcaccatgttggccaggctcgtctcaaactcctggactcaaatgatttgccagcctgggcctcccaaactactgggattacaagcatgagccactgtgcctggcgcagcctggaaatttgaacagtgtcagtcagggcatcttctggttttgaactttctaccgcctttgttcataatgggcagtgtgtgaaactgaactctccatgccttgcattgtccacataagacaagagaactgaggggatcctcttcacacatcagtaacagaaagacctcagcattatatgatcagatcagagagttaatactgcttctctaccataaagacattggcactaagttgctcagttttcaacatacctagtaggtttatcaaaattatgatatttattttgatagccctttttctatttaaagtctttgcattctattggaagtcttttttttttgagacagagtctcactctgttgtccaggctggagtgtagtcacatgatctcagctcactgcaacctccacctcccgggttcaagtgattctcctgtctcagcctcccaagtagctgggattacaggcacataccaccacaccaggctagtttttttgtattttttttttaagtagagatgggatttcaccatgttggccaagctgctctcgaactcctgacttcaggtgatccacccacctcagcctcccaaattgttgggattacaagggtgagccactgtgcccagcctggaagtcttgtgactattaaaaaatcgtttgttccacattggctgggtgcagtggctcacacctgtaatcccaacactttgggaggatgaggcgggcagatcacttgaggtcagtagttcaagaccaacctggccaacatgatgaaaccctgtctctactgaaaatataaaaattagctgggcatggtggcatgcgcctgtaatcccagctatttgggaggctgaggcaggagaatcactcaaacctggaggcagaggttgcagtgagccaggatcacaccactgcactccagcctgggcaacagaacaagactccattccagaaaaaaaaatagtttgttccacattgaaaagatgttttgcaccaggcatggtagctacagaggcaatcccagctacacaggaggctaaggcaggaagattgcttaaggctagcagttcgagaccagcctgggcaacatagcaaaaccccattgctacttaaaaaaaaaataaaattactggccccagtggctcacgcctgtaatcccagcattttgggaagctgaggtgggcagatcatttgagcccacgagttcaggactagcctaggcaacatggtgaaactctatctctagaaataactctatctctagaaagaataaaaagttagccagatgtggtggttgcacatctgtagtccctgtgctactcagaaggatgaggtgggaagatcactaagcccaagaggtggaggctgcagtgagccgtaattgtgccactgggctccagcatgggcaacagagtgagaccctgtctcaccaaaaaaaaaaaaaaaaaattagctggccatgttgatgtgtgcctgtaatcccagctactcaggaggctgggattacagatgggtggattgcttgagcccaggaggtcaaggctgcagtgagctatgatcatgctactgtactccagcctgggcaatggaacaagactctgtctcaaaaaaaaatgttttggtggaattgtaaatagtgataataaagaatagtaaaggaattatggctaatattatatttttggatgattagaaaaatataaaaatgagtaaaagaattttcaataatttggatcaaaatccctggaattagccagtaacagtggatcatgcctgtaatcccagcattttgggaggccagagtgggtggatcacttgagctcagcagttccagaccagcctgggtaacttagtgaatccccatctctatagagaaattaaaattttaaaatatttttaaaaagaaaaacaaatgcctggaattttgcactgctcctctgacaaagaatggtagacatataatagataaaacctttggttaaaacacctagacatgaaaagtttaaagtttgttagaaattttgtaaccagatattttgaatggttttagtagaatcattactttgctttcatagttaactttttccagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagagggtaagtccattagtcatctattgatgtataacaagctacccaaatatgtggcttaaaacaattattatttattttctcccaatttctgtgatcagcaattctgacaaggcacagaggggacaatctctgcagggactggaatcactgaaagcttgtcttaagctggaggatctatttcaaggtggctcactcacatggctggcagtgtaatttcttgccacatgggcctctgcacatggatatggggtatcctcttaacctggtgggtggcttcctctaaagctagcaaatccagagagagcgagccaggcagaagctatccatttatggcctagcctcagaagtcacacagcatcccctctgccacattgtatttgttagaagcaaatcactgagtctgggcgtcattcaaggggagaaaccaagcttataccttttttttaatttttattttttatttttattttattattatactttaaattttagggtacatgtgcacaacgtgcaggtgtgttacgtatgtatacatgtgccatgttggtgtgttgcacccattaactcgtcatttagcattaggtatatctcctaatgctatccctcccccctcctcccaagcttataccttttgaaggggagttgtgtcaaagcatttgtgggcctttttttttttttttttgaggcggagtctcaccctgtcacccaggctggagtgcaatggcacgatctcagctcactgcaacttccgcctcccgggttcaagtgattctcctgcctcagactcccgaatagctgggattacaggcacctgccatcatgcttgtgggcatatttttaaaccatcacagcatcaattgaccatgccaaaaacctagctagtatgcaggaatctgtttttcttttcttgttttttttttttttctttgaggcggagtctcactctgtcaccaggctggagtgcagtggcgtgatctcggctcactgtaacctctgcctcccatgttcaagcgattctcctgcctcagcctcccgagtagctgggactacaggcatgcgccaccacacccagctaatttttgtatttttagtagagacaggtttcaccatgttggcctggatggtctcaatctcatgacctcgtgatccacccacttcagcctcccaaaatgctgggattacaggcatgagccaccgtgcccagcctctgttttccttttgtagtccagcttttgagtttttataactcagtccagattgaggggatctgctgttttttagagagagacaatctaacatcagtaggttttcagactgctatgtcagtgtatcttataaatcggatacattgaccctcttcttaccatcaacctttcaaatccttggccatcataacacttctgagaaactgtagcccacttacatttttggcatctagcagctaaaggggcagtgtacagtagtgttacaagcaggcagtagagcccagtagcctggatgtgagtcccagtaatgctgttaactggcttatatgatttgggcaagtcctttagtctctgtgcctcagtttccctatatgtaaaacagacctaatgataaatccttgtagggtcactgaggaacaaatgggctgatgcgtatagagctcttaaaacactgtctagcacgtaacaagcaccatgtcaatgttagtggtcactgttttatctaattgcctcattttgagtgaggcaaacagcttgattttcttttcctttccttgtatgagttcctgttttacataaggaaggtaaaagatgcagggctcttgagccgctttggctcttgtttgttccaagttcgaagaagtagaacagcgtgtgttttaaactcattgcatgtaaaagtttctaatatgcccatgcttctgggctcaagttttgatttacattttatcacatttcagatagtaagccccacagtctgagaggtgactccataaaacaagaagaggcccagaaaagctttgttgacagctggagacagagatcaaacactcaaggtaccagaatccctgcttctcctgcaggggcctgcatggctctgagtaatatgcagaagaattgcccaggcctctgagaaccggtgccccgggcagtccttcagagagtccagggaagtcaaagtatgtggcttaagcagaagactttataaagtggaaagggccaagggcaggtatgtcccagagccttccgcacccacaggcatcttcctggggcttagtggcagcctagaggacagttggcatccaaagaatccttactgtttccttctgaaagccaccgaaaagatctcccatgtcagaaccttctagagtcatcttgtcttctgcaggttccattttgataaacctgctcctgaagcagcctttgatcccagggtcatccctaagcctttgccacctcctgagtagtagttctgagtctcctgctggcacccccctgcagccaccagggtttggcaggtaagcataagactcctggaaagcttgtttgggaaggagcttcctggaagcaaattcctttctggccctggccagcctgagaagtctgtgggaagggcaggcagcctggagaatttggcaggcaggctgtttggggctcttgaccttatctccatcccacacttaatctatttttctttgtgtttgttgccagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcacttgtactttgctcacatcttgacttatctacactagttagttctaaggcttggttcagggagttctgaagtgatgggaagtggggccaaatgggagaaccaaggaagtggtttatttgatttaattctgcctctgaacaacaggtaagcaaaaggcacacatgattaaaggaggctgctaacctctgtggaggagggccctgccccaggacaagggttaagacaaggggcctctgaacctgagatgtgggtaaggtgaagaccacacatcacaagcacgttgaagtttagtggtttccctaaggaagcagaggatgtggagagggtctgcagcccacgggctgaccttgctgggagtctctgcctgtcattgtgcccatctttagcatgcatctggggtggcctgttcttcttaaggtttgtgggtagtatattatagtgaacctagcgaatgaacactgtgatcataaattcctcccttgggattccagagccgcaagattggggagaactgtgaacacaaccagcccaccccctcatccagtaatccagtctccctcagcactctaccaaagggtcagtttctatgttggaatgattccactggctgaatatatcttaaatcatctcatctctgagctcagcactgctgtttcctagatctgtttccatctgaatatttttggttggtctggcccatgctaaaggtggtactcagctggacacagcactgcagtgtagtgtgggcagtgggatcaggcagactcaggactcaagtgcccagcaggggcccagctcatagtggctgtttttttttgttgttgtttatttgtttgtttttgtttttgttttgagacgaagttttgctcttgttgtccaagctggagtgcagtggtgcgatctcggctcactgcaacctccacttcccaggttcaagcagttctcctgcctcagcctcctgagacgctgagattacaggcacctgccaccacacctggctaattttttatatttttagtagagacagggtttcaccatgttggccaggcttgtctcaaatgccggacctcaggtgatccacctgccttggcctgccaaagtgcaaggattacaggcgtgagccaccgggcccagccttggttatttgtttaataattgttaaatgaatgaatcccaggctgggcacagtggctcctgcctgtaatctcagcactttgggaggccaaggtgggaggatcacttgagcccaggagtttgagaccagcgtgggcaacaaagcaagactcccagctctacaatttttttttttttaattagccaggcatggtggcagtgagctatgaccatgccactgcactccagcctaggtgacagagtgagaccctatctcaaagaatcccagaaaccatgtttttactggtggtagacacaccattattccactcctgttgagcttgtccacagggacattcaaaacacagccacagctgggcatttatctatttcatgtactggggctcttcataaaatttcatttaaagaggttcttaggggctgggcatggtggctcacgcctgtaatcccagcactttaggaagccgaggtgggtggatcacgaggtcaggagatcgagaccatcctggctaacatggtgaaaccccgtctctactaaaaatacaaaaaagtagctgggcgtggtggcaggcacctgtagtcccagctactcgggaggctgaggcaggagaatcgcttgaaccctggaggcggaggttgcagtgagctgagtttgcgccactgcactccagcctgggtgacagagcgagactcagtttcaaaaaaaaaaagttcttaacgctatcaaaaaataacttggaaaccactgtggtgtacataaaagtggattttccttgcagtaccttctgcaagtggcagatattggacatcttacagcccaataatgaaaccaggtaataaccatgttaaaattccagcttcccacaaagggctgcacaccctggcaactaaaaagcattgaactttttgtctgctgtgcaggatttgccctaaagtgagttcaccccacatagtgagaccttgcttcctaaggacacactgagggatatcttgaccttctgtgcttagaaactgcagatgtctgaaggggtacacacctggccagaccccatagagtgtttcagaattgccctcctccccacccaccaggccagtccatcgtgctcccccaggctatgtgggttgagcaaacagcagcagttgccttggggcttggtttattggggtaatagctttccttttgcccctgagacctggggcagtatgcccagaacccctccctcctgcacaccccacagtaggcacattctcccactggcagcagatgtgttttctggcaagtagagaaaatggctttccttgccctgtgagaggtctcataagatccagccatagccaaggccatgtttgtcacctctggaggcctggtcagtccttctgtgggcacagaacatttctctcccacctaagttaggacctgcatccctgtttgggagcatgtggaagccaggcatcccagatccaggaggtcatcccacttcctgggcgatgctacaccagataagggcctgtcctctcagctgcagcagtcttgcagtggaagtgcccacttgttcacatgaaacaagtttcatagcaagtaagtaggggtcaggccagcactgaaacccaagtctggctgaaccaactcacctgttcatactgacttgctcaattttctgttacctctagtggagtgtgaaggtaggttatggagctggggttggggagtgtcacgtctctctgggtccctgtcttttaggttccagtgtgtgttccaagtgctgccaaagtgcctcagcccagagacacccctgcctagcgtgctgctggctgttgagctcctctccctgctggcggaccacgaccagctggcacctcagctctgttcccactcaggtaaagcagggtggggcgggcgtctagactgctcctgcagatcaagggaagggttggggtgggaacagggtcaagggcctcagagggcttctgcagtatgtagcccacgctctttatgagaaagggcaccctgagtgagaggtgcgctgtccttttcagaaggctgcctcctgctgctgctgtacatgtacatcacatcacggcctgacagagtggccttggagacacaatggctccagctggaacaagaggtaaaaactccagagccccttctggacactgtccccaccccatcctaagaaccaacagaatctcctttctttccgctgaggagaaacggagctttaattcattttagtaacaagagttgataaagcaactaaagaggtaaactcagtttgggggctgtgcaccacacagatgcaatgcagacaggacttggcagagttgcctgatgactgatcctgtcttggctttgggacgtgggggcagaatagggggctggaggcaggtgggttgctggtgacacatgagtgcttgtcctgggtcttccctgggaaggtcccacaccacttcttggaccccatttgtgcagacaaacagttgctgaagcaagtgaactcttatagaagcttaagaaaaccctcgcagggactggtctccttctgcccaggatggaaccaatctgttcttgttctaggtggtgtggctcctggctaagcttggtgtgcagagccccttgcccccagtcactggctccaactgccagtgtaatgtggaggtgagtgggtaggggccaacagctggcagctctggtggtaagggggccccgtgcaaggactgtaggccccactgcaaaccccctcacgtgaggtggctaggctgagcggattgttagggtgcaggccatggtggcaccaggcctcagtctgcaccccccctctctcaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaaggtaagcctgccagaggccatcctgcccagcccccatggcttcttccagaggttccccaacaagtcagattcctgggtgtcccctcagcaggcccccgcccactgcagcctgttccagcactggggccattttcttttatcttcctgcctcagttcttctccaagcatattgggatgccttttgcatctatctgttgagtgtgcctggcagagccacggtttttccagaaatagccgtgtctgaattgcctttgtatcactttgtttgcagtagctgagggagcagggcctgggtgtggaagggactggttagttcctgcggacgttgggggaggagaggtgggacctgccctaggccctggcacctttgggccctcaccaggaacctctcctttttgtctcagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 188 - DNA, 18182 bp, Homo Sapiens
taaggcacagagtgaatatttatttatcacagaggtcaagccgaagctctaattttataaatcctggaaaagctggccagaaaagtacagagacttgcccaaagtcaaagctaaagatgcttccagaggccaggagagaagaaaatgttttagtagcactccataactggaccctcaaatctactcactccaagcatcccttcaagttcctgaccccaaagtaagaatctcagtaagaaaaaaatagagatggtttccaaataggaggtaggacaccatgagtggcatcgagcaataactgcaacagtctggctaaagatagctgccacttatgacatctgagcatgaaactagctaattttaaaatggccatttaatacatgcatgtaagaaatcttgtatcccctaaatctatacaaataaaaaactataaatacaaataaaataaaatggccattaaaaaaacaaacaaacaaacaaaaaacaacctgtggcttccaaatcccttatcttttcatttattcataaagatttctggtcccacccatgttccaggacaagttgtatcaatataccccaatcctttctaacgccctgagttctttcttccacatatcttctaattcgtggtctgggagggaaaagggtagtggagttctcaggtggatgacatctccaaaggggagaggacaaaggcctctggcttggcttcctgcttcagcactccagtcagcaggaactcaggcgagaggaggggcagcccaacccgtagtggaatggagcaatgagggaagtcctgagggcatgtgatcacaactctctgaggctggggaagacagagcaaaggcaaaatcaggtgaaaaagaatcctagaaatgggttcaggacccactaaccagtcttaccatcactaaaataatacctcctaatatgaagccaagtgaagcacaccgcatactgtctatgaaatactcttgctaggccgggcgcagtggctcatgcctgtaattacacagcactttgggaggctgaggcgggtggatcacgaggtcaggagatcaagaccacggtgaaaccctgtctctactaaaaatacaaaaaaaaaaaaaaaaaaaaattagccgggcgcgctgacgggtgcctgtcgtcccagctactcgggaggctggggcaggagaatggcgtgaaaacccaggaggcggagcttgcagtgagccgagatcgcgccactgcactccagcctgggctacagagcaagactccatctcaaaagaaaaaaaaaaagaaaaaaaaaaaagaaatactcttgctagaggccaggcacagtggctcacgcctataatcccagcactttgggaggccgaggtgggtggatcacgaggtcaagagatcgagaccatcctggccaacatggtgaaaccccgtctttagtaaaaataaaaaaattagctgggcgtggtggtgtgcgcctgtagtcccagctactcgggaggttgaggcaggagaacagcttgaacccgggagatggaggttgcagtgagccaagactgctccactgtactccagcctggcgacagagtgagactctctcaaaaaaaaaaaatacttttgctagaaagatgaacctgaatttattcaagcttttacaattatctgcaatttccaggaaatatggagtacagaggaacaagataaattatatgacaaggaggcaaacccaaaattccagactgaggaacattctaaaggacaagtgacccagcttctgcaggaaatagatggcataaaaaaagctgggtgggttaagggatgctctagagtaaagataattaagaagataataggtgtggcagtatgtggaccttatttgaatcctgatttgaacaactgtatagagacatttttcagacaatgggagaaattttattaatggagtgtgagcaaatgaccaataaactactgttaattttgcttaggatcaataatggcattgtgattatgaaataaaatgtacgtatttcttagagatatatatttaagtatgtaggaagaaataatataatattggcagtttgctttaaaatatttcagcaaagaaagagaaaggaaaaaaagaaagaataaagaaaaataaaaagaaatgaaatacttcagcaaagaaaatcaaaggaaaaagccgggcgcggtggctcacgcctgtaatcccagcactttgagaggccgaggcgggcagatcatgacctcaggagatcaagaccatcctggctaacacagtgaaaccccatctctactaaaaatacaaaagaattagccgggcgtggtggcgggcacctgtagtcccagctactcgggaggctgaggcaggagaatggtgtgaacccaggaggcggagattgtagtgagccgagattgtgccactgcactccagcctgagagtgagactccatctcaaaaaaaaaaaaaaaaaaaaaaaaagaaaatcaaaggaaaaaagggatagatggagcaaatgtagcataatctaaattaagctgctgctgaatctcggtgattgttatatgggggtatcagcagatctgtcccctcattcctatccctttctataccataggtcttttcccccaccctctcactactttatattcctttctgaacctccatttttttccctccaatctttgccattccagccacctctttaactgccactgccacctcacccagacccagaacatcctaagcataccttataggaccgaggcatgctgggtaggtatgtgcctccacagcagctaataatctctcccatctgaggtggtggtggctggactccaggggtcacatagatctcatagccctaagagaaagaaatgatggagatggtattgtagattgggaagcactggagggagggctgaagcacaggttaaaagatagcctctcacctctagcagccttcgctcccgagccctgctcagtgcgtcttgaaggctaaagccaaagttcttctcttgctcagggtcggtcaccacatattcatccgggggtaagaagaaaccagccttgcgggactaaggacggcagcagtcagcatcaaagctcagcccagcccctcaatcagctctgctgcctagcatttagagagagctcacaaaatgtcttttaaatcaatgcaggcttctggctcaccaatgcccctgtcttcctgtaacgcctcttcccttccaccactttctagggcactatatgagcagtcttgccactatatcggtctgtcatcatcccttggcctctcacctgatgcagccagtccagggacagaatggggattccccgccccagggcacacaggaacttgactgtccggcggatgcgatcagtgaccaggtgggaagcctctgccgctgaaccagccagacttccccccagtgccagcacagcccgctctccccgagcatccaccactcctgtgaagagcacctgtggaagggttgacctgaggtggttacggcaacccatgccatcagcacccatctctacaatcctctaggtctccttgcatcctcccctcatctctgtctcccacaaagtcccatgcctttgtctcttactttgggggctgttgattcttggttaagtttggtccgtcggaggctgcggcttggtattctgttgggctcctcctctgcctggtctctctttctcttgcctggttttggagtcacgacatcctgagattgagaaaaatcttggtgggagtttcagagccctgaagtcatttttcccagctttgtggtcccaaccctctcctcacctcttccttccctggcttctctgcagtatcttcttcctcttccttgataatcactgtcttctgggagacttcccctctttggggctgtttttgatgtggtggtgaatccatggtagctaaagacctcttgcggctttgagaggccttaggctggagctccggggtgaacctagatctacctgctggttccaccttttggatctgggaggcatgaattggtgtctcaagaagctggggagaggcaggctcaggaatggctgtaagggattcagctgctctcactgctccccatctttggttccttgaggcctgggatttaggttccaagggtgcagagcaaggcttatggtcaatgggagctgcgagggagccagggttcccagcggctctctgcctcttgatgcaactgggttgagtaataggctcaggggaaataggctggtctgtggtgacaggagattggaattcaggggtggtaggaaccggcatagctcttactgtggaagacctcagtgttttgctctgaccaccctgagctatggcctcaggggtgacggactggtctgtgggggtaaaaggctcaagatcagaggctgctggttcaactggtttgggagtcttgacagaggacctatttgtctttctcctagtggccctagatgtgagcttgggggtgacaggctggtctgtggaggtggtaggatggggctcaggggctgtggggacaactggctcaggggtcttgacagaggacctatttgtcctgcacctagtggcccgagatgtgggctcaggggtgacaagctggtttctggaggtggaaggctgaagctcaggggctatagggacaattgattcaggggtcttgacagaggacctatttgtcctgcccctagtggcccgagatgtgggctcaggggtgacaggttggtctgtggaggtggaaggctggagctcaggggctgcgggcacaactgtttcaggggtcttgacagaggaccgattttttcttcccctagtggtccgagatgtgggctcagaggtgacaggctggtctgtggaggcggaagcctgtagctcaggggctgtggggacaactgtttcaggagtcttgacagaggatctatctgttcttcccctagtagcctgagacgtaggctcaggggtaacaggctggtctgtggaggtggaaggctggagctcaggggctgtggggacaactgtttcaggggtcttcacagaggacctatttgtcctgcccctggtggcctgagatgtgggctcaggagtgacaggttggtctgtggaagtggaaggctcgagcttaggggctgtggggacaagtgtttcaggggtcttgccagaggatctattttttcttcccctagtagcccgagatgtgggctcaggggtgacaggctgctctgtggaggtggaaggtgggagctcaggggctatagggacagttgattcagggttcttcacagaggacatatttgtcctgctcctagtggtccgagatgtgggcttaggggtgacaggttggtctgtggaggtggaaatctggagctcaggggctgtggggacaactgtttcaggggtcttgacagaggacatatttgtcctgctcctagtggtccgagatgtgggcttgggggtgacaggtcggtctgtggaggtggaaggccggagctcaggggctgtgggcacaactggttcaggggtcttgacagaggatctattttttcttcccctagtagcctgatatgtgggctcagaagtgacaggctggtctgtggaggtggaaggctggagctcaggggctgtggggacaactggttcaggggtcttgacagaggatctattttttcttcccctagtagcctgagaggtgggttcagaggtgacaggtcggtcggtggaggtggaaggctggagctcaagggctgtgggcacaactgtttcaggggtcttgacagaggatctactttttcttcccctagtaacctgagatgtgggctcagaggtgacaggctggtctgtggaggtggaaggctggagctcaggggctgtggggacaactggttcaggggtcttgacagaggacctatttgtcctgctcctagtggcctgagatgtgggcttgggagtgactggctgggctgtggaggtggaagggtggggctcaggggcagcagaggtagctggaaagggtgtcattctggaggacttccgagttctaattttaggctttgggtggaaaggctccagctctgaggacaagggagcctctggagcttcctgactcccatcttgcctggtcttacgaacggttggcttgatagaaggtaaaaggggagaaagaaggggcggaggtgcaagatgtttctggctctgagagttaaggggcttttggggtggggctggggcttcaggtactgtaggaggcagacaagcatctggagattcctgatcgccctagggagaaacagaagcaagtgagggggaggaggtggagaaaagagatagaacttggatactgttcttgatacttgtttatggttagataggcttaccagatttccaccgggcgtggtggctcacggctataatcccagcactttgggaggccgaggcgggcggatcacgaggtcaggagttcaagaccagcctggccaacatagtgaaaccccgtctctactaaaaatacaaaaaaaaaggccaggcatggtggctgatgcctgtaatcccagcactttgggaggccgaggcgggtggatcacaaggtcaggaaaccgagaccatcctggctaacacggtgaaaccccgtctctactaaaaaatacaaaaaattagccgggcgtggtggcgggcgcctgtagtcccagctacttggaaggctgaggcaggagaatggcgtgaactcgggaggcggagcttgcagtgagccgagatggtgccactgcactccagcctgggggacagagcaagactctgtctaaaaaaaaaaaaaaaaaaaaaaaaaattagctaggtgtgttggcaggcgcctagtagtcccagctacctgggaggctgagggaggagagtcgcttgaacccgggaggcagaggttgcagtgagccaagatcgcgccactgcactccagcctgggtgacagagtgagactgtctcaaaaaaaacaaaaaaatacacaaaaattagccgggtgacatgcgcctgtagtcccagctacttgggaggctgcggcaggaaaattgtttgaacccaagagacggaggttacagtaagctgagatcacgccactgcacactccagcctgggtgacagagacagactctgtctcaaaaaagaacaaaaacaaaaaatatgctcactggattttcctttctgtctatgatctctcctccattagactgggatctacctgggaagctacctttttcccacagacctgtctccataatgctactatagtgttctccacacgtggatgatggtaaggaaaaggatggctggggcaaagaaagaagaaacacgaagggtctttcttttgagtcaggtaggagatacaacttaggaaacagatatggaaaacaacgggtgccgaggataaaggaatagaagccaatcaaggcgtgacaaaaatggaagaaaactgaataatgagaaaggaatagattaaagtgaggctaggtgaaagagcattggagaagatatagagatgacttgtggaataggaggtagaaaaagtagctctcaccctggaaaccttctcagcagctctgatcctggaagccttctcagcaggtggcatcttgcaattcaggaggcctagacagaaagtaaacacaaaggtggctgagttccaagcagctggttgcccaggggttgattatcacgaggcctgtgtatcaccttgggttcccctctgccttcacttacctttctgatgcctcctggggctcactggggatccccttccacctgactggctcccagaaggtacgggggctgaggtaggtcccggaaggtcccccgcccccaccccaggctctggtgttgggctggaggcctgccctttctggtcctggctccctccctctggctcccctctctgtgtatctctctccaggatcactttgggcaccttctcttctaactcggctggatcgcactctctgtttgctactggtctctctacttctctctcaaatgctttgcttggaagggtctgcttctgtacttgtttctcttgtatttcctcagatgtctcaatttctaccttcaaactctccctatctctttcaggacttgcactttccccatttttgtcagattcttgtctctgggtgtctctagctaacaactgtttttgttctctgtcctgtttccccttggttaattcttcctctcctgtcacatctgtctgtctttctggtagcagtttctcagtttctctctccaatggccctctctcagggcccaccctctctgctgtttcttttggtatacccatgactttatccacagtctgcctccctctgccttgaatccccattggctctgtgtgaactgggctctctggatgttggtctcctggtattgccctaggtggagacaggcaaggtccataggcctcaaggtgcgtgtcaaaaggctgggtctcagagtcctcagactctctcagacagaatggctgtgtagccaggacctcccatggttcatctagggtacctggaaggggaggaaggaagagagagagagggagagggagagaaaagagggagaggaagagggaaagggaagtacaggttgacataataaatatgatgagaaaggatttagataaactcatgaataataaatctgaacaggttattaaaggtaagctgggaataagggtggtagttataacatttaacgtttgtctcaaaaaggtcatagccttaggcgggcatggtggctcagacatgtaatcccaggactttgggaggccaagacatgaggattgcttgaggccaggagtttgagactagcctggacaacatggcaaaaccccatctctacaaaaaatacaaaaaaattaggtgtggggacggggacctgtagtcctgtagtctcagctacccgggaggctgaggtaggagaactacttgaaccccaaaggtcaagactgtagtgagctgtgatcataccactgcacttcagcctgagtgacagagactctgtctcaaaaaaaaaaaaaaaaaaaaacccaagagaaaaagaaaaacatcatagcctaatatgagttccctgaatagtctctcatcataccactgcattccagcctgagtgacagagaccctgtctcaaaaaaagaaagaaagaaagaaagaaagaaaaacatcatagcctaataagagagttccctgaatagtctctctctctcaagacagtttcactctgtcacccaggctggagtgcagtggcatgatgttggctcactgcaactcccaactgctgggctcaggagatcctcccacctcagcctcccaagtagctgggactacggcatgtgccaaagtgcccggctaattttttgtatttgttgtagagatggggtttggtcttgaactcttagactcaagtgatccacccacattggtctcccaaagtgctgggattacaggtgtgagccaccatgcttggctggaatttccttctttttaaaggctgaatagtattccactgtgtatatataccacattttcttttttcttcattgacacataataattgtacatatttatggggtacctgtgctattttgactcatgcatacaatgtacaatgataaaaccaagataattgggatatccactatctcaaacatttatcatttctttgtcttggaaacatatcaaatctcttctagctattttgaaatacacaataaattattaactatagtaacactactgtggaactgaacactagaacttattcattcaatctgactggatttttgtattcattaaccaacctctttatgcattctgtccctctacccttcctagcctttggtaaccaccattctactctctacttccatgagatccatgtttttagctcccacatgagtgagcatacaatatttgcctttctgtgctgacttatttcacttaacataatgtcctcagggttcatccatgttgctgcagatgacaggatttcattctcttctgttgctgaatactgttccactgtgtatatatacacattttcttttttttttagattgagtcttgctctgtcacccagtttggagtgcagtggcatgacctcagctcactgcaacctctgcgtcttaggcagcaatcctcccatcttagcctcccgagtagctaagactacaggtgcatgccaccatgcccagctaaattttgtattttgagccactgcacccagcctatatacacattttctttttttttattattagagatgaagtctcactctgttgcccatgttggagtgcagtggtgtgaccttggctcactgcaacctctgcctccggggttcaaatgagtctcctgcttcagtctcccgagtagctgggactacaggcacctgccaccatgcccagctaatttttgtatttttagtagagacagggtttcaccatgttggccaggctggtctcaaactcctgacctcatgtgatccacccacttcggcttcccaaagtgctgggattacaggcatgaggcactgtgcccggcctacattttcttttctttcgtttttttgagacagagtttcactcttgttgcccaggccagagtgcgatggcacaatctcagctcactgcaacctctgcctcctgggttcaagggattctcctgactcagtctcctgagtagctgggattacaggcatgcaccaccacacccggctaattttgtatttttagtagagacggggtttctccatgttggtcaggctggtctcaagctcccgatctcaggtgatctgcctgccttggcctcccaaagtgttgggattagaggtgtgagccactgtgcccgaccccggcctacattttctttatccattcatctgttgatggacatttagtttgatttcatatctgcctattgtgaacagtgctgcaatagtgtgtgtgtgttttttttaagagacattgggggtgggggttgagggatgggctattgcccagactgggctcaactgatcttcccatcctggcctcccatgtaactgggactacaggtgctcactactatgctgggctaattttttcatttttgtggagaccaggtctctctctgttgcccaggccagtccctaaatattttcaacctgcagctggttgaattcacggacgcaaactcgcatacacagagggctcactgtaatcagagtatgaaagaaacatgtaggaaggcaaatcaagaaagaacgcaggccgggcgcagtggcttacgcctgcaattccagcattttgggaggccgaggcaggcggatcacttgaggtcgggagtttgtgaccagcctggccaacatggtgaaaccctgtctctactaaacatacaaaaaattagccaggcatggtcatggacagctgtaatcccagctacctgggaagctgaaggaagagaaaccgcctgggaggcggaggttacagtgagccgagactgcaccactgtaatccagcctgagtgacagaggaaaaaaaagagaatgcagaattggggacacagaggagggaagagtttcttatacctgttgtctggaagctgcaatgggaagggccaagctcttggggtggagtcaacatgaaggcctgggtaggttcatcctccatgctctggactgctgtacaggaaaagatggcctaagttcatctcctccatactactgtagggttccattcctggtctcctaccctacccatactagcctttacccttcaaggaccaccagtctaatctcccagctcccactggtacaggattcaaataacacagaagtcctcaccttccaggccctgattctccagaaagcactgggtagcttgtaggtccagatcttcagaatctggtcggggaggaatataagacagtttaaaacaaaaatcatacctgacactaaactccttaaataatctctacctttctctccccaaccccagctgttagaaccctggttgatttcagaggtctaggaaggaaggccagcacttaccaccatagttgtcttcagagtccttggtcccacccacatgttgttctctctcccttcctgtggggacctgggctccctctctctgtggctgggtggattcccctagagtgtctgtgtccaccaccagatctgtgaggttctctcttgagatagggaggtcctgctccacttgtgccacaggtggcccaccctgggcccccacctcatgagctctctcctgcttaagaacagctgcagcccactctgccccagcatccccttctgctggaagctggctctttcttacatctgcaactactgaggctgttagggaggtgccctcctctgcatctgtttcacagtccccatgcagaggccaggcttcctctagagataccacaagcagctttgctggtcccccaactgctttcacatctgtttgatttgtcccctccacagacacctgatgcttctttatatgtataatggctgaccctggcgggacttccttctccacttgtgtgttgatgtccactgtggtggaggcttggcttctctccaggtggatcccaggtgagctcttatctgcttccacactgtcatcactgtccccaaaaggaggttggtccttttctgaatgtgctctaacaagggctctaatctttgtgtgatccttgaggacagcttctctattttccactgggagctcttcctcctccacgtctgtgtcactgtctctctcagtggtggtttggcttcgctgcagaaggaccacacgttggggcatgtcctcttctgcatctctgttccatatagcaggctggctctctttcagatgtgccaaagtcagcgctgctgagacttcttcctcgtcatctgtatcgctgttgataaccatggaagcttggcttttctccagagggacagcctgtggggccttgccttcttccacatctgtatcactaccagcctggctctcctgcagatgggccaggcctggtgctccaggaccccttgtacctactccatggaagatcttcctcttcttcataggaatgacaactggggttgctgggatcctctcttcttccgcatcagtgtcgctgtcgatgaagccaaaaggctgagccctttccaaatggacctcagctggccttccaggaggcctgctgtcatcatccacatctgtgtcactgtcctctccaggaggttggctcctctccagaatcaccccagctggaaccaccccattccctgcacccctcttgacttttgtatcattgtccctctccttcactaaaggctgatccttttcaagctggatttcagttacaacttcagcttcagactgctttgcctctacagtggcacctcttctggcagctgaggaggcctcctctgtggctggttgctgaccttcttccacatctgtgtcactgttcaaattgaaggcaaaaggcggcccaaggccgcccaggaccggggaatgcccctcttcatcactgtgaagggaagaaaagagagtctatagaatttatttccctggaagggataccccaactcaactgtgagctccttgaggggagacacaaggtagcatatttcttcttctgtttccaatttgttttccacttggcacatcagatgtgctccataaaaattcagctgagtgaatgaatatgtatggttccccagccccaactctcatgataatcatctcttttagagattgatcctccagcccctggttcttcctcattttgaagactcaggtgtctgactctttggcactcacctctctggaactatcacagaggaagatgtggtccttgatttttttaccatacgcctttcagaaagaaaatctgtcaagaacagaaaggaatgagttgacaattgtacactcattattcctgtctcctcattctccctgccaatatacaaacttacctacttcctcctccgagtcctcagccaacagaagcctctggggttgagtttctccctgtactctgggtgtctcttctactgtcagagggccccgggagacaaagggcagagagacatccaggcgatggtactggcagagcaagtcagcaaagagaatcaattcctggtccctcagacggtgactcaccccagggctcaaaaccttaggaggtctcaggatttgagtaccattaaggctcccacagtctcggaggataggtgccttgtcccaggctaagatttcaatctctgcatgttgtttggagatagatggaaagggcagggccacagagcagtcaggcattcggcctaccacattcttcccgaggtgtagtgggaaatctaagaattagagaggtagataagctccaagatcagagtcctggcctgtcattaggaaaaagtgcctattaggtactctactactcactcaaggcctccatatgcattagaaaaataaaaggccctaggacatctaggcactgaaagagtatatgcgataccccatccatccacaatggatgtttttttactgttataaaatacacataacacaaaatgtatcaccttaataattttaagtgtatagttcagtggcattaagtgcattcacactgttgtgcaatcatcactaccatccatctccagagcacacaattggattttatttgattttttttttttttttgagacagggtctcattctgtcacccaggctagaatgcagtgtcatgatcatagatcagtgcaatcttgaactcttgggttcaagtgatcatctggctcagcctcccaagtaggtgggactgcagatgtgaaatgaaccaccacacctggctaatttttaaatttttcgtagagacagggttttgctatgctacccaggctggtctctaactcctagtctcaagtgatccttctgccttggcctctcaaagcacgggaattacaggtgtgagtcactgcacccagcttcatttcaatctcttaattttcttttatcaaagtaaaatcacttccagtgagtccagggtagtagtctgcaactatcaactcaatcggccccatctcttccattcatgaaaaaaaaaaattcacatctcattgaaacatacataagcttcttgcaaccctccaaataccttaccacaaaaataaaagatctatatcaatacttgaacatccaataccctctgacctttttctggtccatgggcaccactaaagatatgtagccgccctactggctccacgttacacctcaaggattcactggattgctctgtctcctcctcttcttcaacatcccagtcaatagcctgggtgtcctccatgatctgggaaggatacacattatcaattatcctcattattggttcacacaaacagcatcagagttatcagactgaaaactagggggtaaactggatcattatgaacgttgatgcttctctttccaccaatctttctgttgttaaccttctgaagcacttaaaacatttttttcttttttgtgatggagtctcgttctgctccccaggctggcatgcagtggtaagatcttgggcccacggcaacctctgcctcccgggtttcaagcaattctctcacctcagcctcccaagtagctgagattacaggcacctgccaccatgcctggctaatttttgtatttttagaagagatggggttttgccatattggccagggtggactcgaactcttgaccttgggtgatccgcccaccttggcctcccaaagtgctgggattacaggcgtgagccactgcgccccgttgtttttctttcttttttagcccatgctttttatacttttaccagaccacctcagtttgatcagatgcaactgcaaaaaatgataataaaagatgacatatatagaagcttcctatgtgtcaagcactgttctaattactttatatcgactctgactcatttaatcttcacaagaaccttgtaaagtagtattactatcttccatttcttcagataaagaaactgcaacatagctgggttaagattttcagatctccttgaaacatacataagcatatataaggttaagacttgccccaaatcactcagatgtctctcctctaaaatcttgatggtttttcgtgcacacagaataaaatctaaactccttagcgagaccctccatgatctgaacttcacatcttgtaacgcctacccctcgcccgcaaaagcctatggttcagccagacattttccccagtcttcgaacacactgttcttgtcttcccacatcttcatgccttagcccaattccttggctttttcccacctagttttctggtccaacttctaccatcctttaagattcagttcaaatgtcactttctttcttttttttttttttgagatggaatctcgctctgtcgtccaggctggactgcagtggtgctatcttggctcactgcaacctctgcctccaggcttcaagcgattctcctgcctcagcctcccgagcagctgggattacaggcgcccggcatcacgcctggctaatttttgtatttttagtagagacggggtttcaccacggtctcgagctcctgacctcaggtgatccgcccaccttggccacccaaagtgttgggattacagcagtgagcaaccgcgcccggcctcaaatgtcactttctcagcaaaccctttcctggcgtgttccctgccttctcgtgttcctggtgtatcctgcctgttccacagtggtcaatggatttgtgcttactctaagatctctcgctatattgtaaccattactttccatttctgccttcacactcacccacctccaggactggattaggggaaccgtgtctttcccctagggtccatcatattcattcaatggttatggtatacctgtttgaagtatttggtatacatctgtgaaccaaacatgaaatcgaccctgccctcgggaaggctcatcaccgagcctactgatgaaggaacaaatgagatggaaagaaaatagcataaatggaattcacctgaaaatatgccactctagagggaaactgttgacaggtagggaaagtaggatgccccatggataaagtgtcaactccgtctttatgacaggccaactcagcgggtgcccaccacgcttggctccaattcaaagagccaccatctttggtccccacctcagtgggttcccttgtggcccgacgtctccctgtgtcttcatacctaaactcggagcggggcgccaggtaaggatgagtattacagtccgagaagcgaacttccaagtcacctccgcccagtcgcacccaaggtacgcccctcccgccttctgggggaaccaagatggctcccggggagccgtgggccaggcccctagaactcacctactttaagtccccgcgcgcgccaccagtaacggtcgcgacccaggtggagcgactgcgtgtgccgaaaaagagcttatttgctgattggcttctgccgctgtctttcacaaccgcagccagtcgagcggaggcacacccaaagccccgcccccttagagttcaaataggtggtgtctcccaggctgctgagatcagttaatgagacggtaattgaaggccgccgtgcgccaacagaataatgcacgtcgattgggcagctccaagggacaacccactaccgcttgcccgcccaccacccacttcccgcgcagttccaaaccgcgaccagagagtctggcgccagctgccggcaacggatagaggggctgtgtcatagacgtccgacgtgtctggtaaggccagagcgcctttcctcggtcctcctagacatggtgtccgctgactcatgagaaatgaaagtgggttgcgcgttgcagtcgtggctggaggctgcagtttggagaacagcccgtaggcgtggcagttcactcctgttgcattggaatttcatttccttttgatttggtttgtagtagaagtaatatctttcttcctgggaatacgtctctgacggacattttgaggtcattttcttaaatccaagatcctaaagatctgtagtcgaacagagaaaactggtttgctctctgtcttaaaggctgtccccacctttcgaggggcgagggaaggatcataaaatca

SEQ ID NO: 189 - DNA, 10416 bp, Homo Sapiens
tttctcaggacccaatagattttatttcaggtggggataagggacaagcaatgtgaagacagggaaggaaagaaggaagtctctatgttctgaaggactgcctaccccactgttgagagtgccacattctgcccttttagcaattttaattaatttttactaggactttggtaacaccacagaaaccctgtggcttcctgttaaaatgactgtgttacatgccttatttttattaaagtggaatttaacaaatacttttattattttgaagcatttcatcaattctcggtggaagcactacatcatcgaatgggaaatcaacaaatgaaaaatgaaaaaaaagattatccattcacagtaagcaccattttactagaaagagagataaacttcaaaaagacagaactaaaagtctttaaatataagactgtattcttctatatactacacatcaatttgtagtggcaccaaagtgtcgcctgctctgcctgagggagcactccccctagtgattttccataggaaataaagttaaacttttattaaagtaaaaattcctgggtcaattagaacacaaataaggaggaaattctttataaaataagtaccttgatgttagggtgacttagaaacaattcattagtctttgaattctaaatagctgaagacatgcagctaaaacaataatttttattttaattttttttgtttttgagacggagtcttgctctgtcacccaggctggagtgcaatggtgcaatctcggctcactgcaacccccgccttccagtttcaagtgattctcttgcctcagcctctcaagtagctgggattacagacacccaccaccacacccagctaatttttgtatttttagtagaggtaggggtttcaccatgttggccaggctgatctcgaacttcctgacctcagatgatccccctgcctcggcttcccaaaatgctgggattacaggtgtgagccaccactcccggcctaaaataatagttttaaatgtacaaaaatatccatccttactgagctgatttatatttgttttaaattctttttagattcaacttttaaaaaatacattaggccaggcatgatagctcacgcctgtaatcccagccctttgggaggccgaggcgggtggattgcttgagctcaggagttcaagattagcctagggaacatagtaaaaccccatctctacaaaaaatacaaaaattagcagggcatggaggcatgcacctgtagtcgtagctatttgggaagctgagatgggaggattgcttgagcctaggagattgaggctggagtgaactgtaatcctacaactgtactccagcctgggcaacagagcaagatcttgtctccaaaaataaaaataaaaaaactgagatcaaaataaatttagagctaaatcatcagaattaagtagtgactaataagatgctaaaagaaaatctgaaattggagagtctttcatctaacagagttactaaatgcccattatatgttaggcgccgttctttgttcacactagtaacaaaagacaaaaaataactatgctatttcacatttaacagtccttagaatgttgactgattagatattttcccaagtatcttttaggtttgttctgttcttggtggttatctaaacaaaaaatactctgacaacatttagtaaattcatttgtttccttcttgaatacaaacattttagaaaattccaacttcttttgtagtcactgctaaattttgtatgctgagattgagacacttactagttatcaggtgctgaccctggccacctcccagaattgtccatatgcctgggaagcagtgcctgccattgtgctggagtagcctccttgcagcacactttgctgtaatactctccaaaccaattttctctaatgctatgtgacctatattaaggtagggcattccaatatatcctccaattttggtgaatacaattgaatggttctcaacaatgaatagtttggcacacttttatttgggggaggtggggtggtcacaatgactagcatcagtgggtaagggccagaaaggctaaatgaatcctgcaatgggatgacaggtttttatcctaaagaactgtctcactcaaaaggccaatagtgactgtccatggagggacactcagctgttgtcacctggtacagtaacaaagacagaagcttcactttactcatgtaattttttctactagacaggaagataatttttgcattttattaaatatatttatatgccacaaaaattattttagtgacaactaccaggaaagtacaaaatcacttaataactggttttctacaccttgatttgtcaagaaactcataagcaaatggaaagtagtaagtactgattgcagttacttacagcaaacagttttgagaagaagaagaaaacctgtaacactgaaaattgctttatatcccattcatagatctcttcaaaaggtctactttaaaaataaatcacataaagaattgttcagacttgtttggtgatgcctcaacttcagaacatttgcaaggaaatcacatgtaaaagcaatcatctcatacaattaaatgctattaaagaaaaaaaaagtttcctttaaaacagtggttcccaaaatttagcaggcatcagaatctcctgagggaagcttgttaaaatacagaatgctggcctcctccccagagtttgctacaagtttgcaggccattctgatgttggtgcgggcacaacactttgagaaccactactttaagatctagtctctagaattcaaactaataagcaatgcccatatgcctttgctttttctaataataaataaataaaagatcatttcaggtagctgcatcaaactttaagcctttagactttttttttttttttttttgaggcagagttttgctcttattgcctaggctggagtgcaatggcgtcatctcagctcaccacaacctccgcctcccgggttcaagcaattctcctgcctcagcctcccgagtagctggcattacaggcatgtgccaccacgtccggctaattttttgtatttttagtagagatggggtttctccacgttggtcaggctggtctcgaactcctgacctcaggtgatccgcccacctcggcttcccaaagtgctgggattaaagccaccacacccggccacctttagactcttgaaatgttacgctgactcacaattattcccatgagttcaaaagacagaactaaaggacagtcctgaataatctatgactacaggaaaacatttatttacatgccctctacaaaatggatttacaaaacatagtaactattagggtacatgaccttgctcctatcttccccattgtgcttcttctctatagaaaatccaatatgaaatgacaaagagtactgtactcagaataagaacttcatctatcataaatgtacacataaatatcagtgaattgtcatactcaagactcagattcaggaacttcttcatcagggcagcagtaatattccacaaaacatatttgtccatcttcatttctaatcatatactgtaatgaaaggaagcctctgttatctgtccgaatagataccttacaagataggactaatgcctttgtagagggtttcagtaaggaaatcttgtatctgtagaagaaaaaataaaacgctgttatatcaacacagtgaacactgctcagaactcccaagtaaaggataaaaagtagcaaatctaagaataaaatcaagtacttatccaatttgctaatattttctgttttaaaattcattcactgttagaaccctacatcccctagtaagtccagcactctactattcatttttataaaatgctgtgcattttaattaacagattgaaagtgtttttatttaacagaaatctggtatttaacctcctctttatcaccaatgacaacctctatattaagaactgacctgttgacttgggtctgattacaatgaaatgcttccatcaaatcagaatctttgggatagtcaaggtgggaacttcctgcatttccaaaagtagataacctatagaaaatgattacctcatttattcattcatccaaaaataaaccacattaggatccaaataaagaaaacacttccttaagaaattcatactagtgggtgaaacagacatgtacacaaatgcttataacacacgataacaagtaccataataaagctcccactggagttcaggacaactaatcaatgggtttgaagaaaatcaattgtaaaaggaaaagggtaggggacactttaatttcattaccctaatcctactctgaaaatgacttttcctcatccttaagtcagaaatatataacaggcgagagaattgaggactcatggaagaccttgatctaagtctactgcaacccttaggtctgttcccaatcctacacctaggaattacagcttttctgtatcttagactgctcttaaggctattgcatggttttcctcacttggtaataccagaagttatttgtagacaatttataagtgttaacatgctgatttaatttgcaagaactcctggaacatttgctgcaggattagcacgttgctaagtattatatgagcatggcgataagatccaggttggttttccctaagctccatttctgcctcccatcttccaggtgtggttttcctggggtccatcttttctttcttctaatataatctctctctctgacccgtctcatccatacccagccatgatgatggttcccaaatctaaatttccagtctaaatggatctcctgagcaccataactacatatccagccactccctagtgtcgcaggtacttaaaatttaacatatccaggaaaaaatttcaactcctacctccctaccaccaaattgtttcccatcctggagatgaaagataccatggtccatctcgttacccaggctgagagagatcactgaggagatcccctgaaatactgttttaagtacctgaattttttacttcattccactgctaaagtaaggtttccaatttccattttggttaactttctcagaccttgagccaaatttttaactccccaaagtcatgacaagggcctgtgattctttttcttttctttttttttttttgagacagattctcactctgtcacccaggctggagtgcagtggcgcaatctcagctcaccgcaacctccacttcctgggttcaagtgattctcccacctcagcctcccaagtagctgggattataggcacgtgccaccacgcccaactaatttttctatttttagtagagacagggtttcaccacattggccaggctggtcttgaactcctgacctcaagtgatctgcccacttcggcctcccaaagtgctgggattacaggtgtctgccacagcacttttacagccgggcctgtaattcttctaaagtagttacaaaaagaataccttattccttttattccatatgtatttaggggctttaatattctgaaatatttcaaaaagagaatatttagatcctctctctaaattgctagaatctctgagtctaatcctgaaaagagacttgtgttaaactatcaagaacagcttttttgacattgtactcctgctgaaaactgccctcccttgggaagccagccttgagcaatcctccctaaatccttatacagcatttcccaggtatctgtgtgtgctatcttggtacttaatggtttgctgtttcacattttcttggcttcaccttggttttaagctgttcttcccacaatgcttaataagatgaataagcacacggtaggtgatcaacagatacttagtgaatgaatgagccacgtgtagaaaacatcttcttctgcatcctgaactaacttgaaaaagataccataatacaaacaccctttccaaacacttaaacccaattttcctcatgatgtaacctgatctatgaaagtaaggagtagtacaatgaaaacaccaccagtttataaattagaggactgggcttctcatctagatgccaccaccacctaaatatgaaatagtgagttaatcttcctgggtcttaagtttcttgatccataaaattatgaggtaagagtacaagctgtctaaagttgtgaaaactctaaaaatgtggataataaaaattttgcatcctaagcaaatgtctaagtgggaagatggagtacagaccacattaactataactgcactgctctcaagtacctgaaataaggcttgtcaggagacatggtaatttgtaggacttcactcgtcatatccaattcagaaaatgcttcacggagcccctctgactgcagaataattttattaataacattggtgctgcagaaatcaaagtccagggtctcctcaggttcctgtgtattgattttgcagactgtcaccactcctccttcttccaggaacagcatcaaagggtaaccataaccttggtaacacattcgaagtgcagttaaagtccctgcaatggaaagaagtcatacttggccttagctttatagttctgggttcagcttctcctcgaaatgatacataaaatttctcaagaataatttattccgcccaatttctcacatatatgtatctcctcataaaaagggatgacatcttccctgatgacagttgtgtgtagagaattccaaaactacaagaaaattgggaaccagaacaaaatgtaacataattctttggaatcattttcaggttgtcatacacacctcagaaatagcttgttgattttatatatgtacaatttcagggtagagaatctatatggatcaacacagcaagtaactaaattgctgcagaacagggtatgctattccttgaaggttcaatgtgtgtaacagtggattgctgtcatctgtactgtaacgtcagtgtactcactatgacaaggatccttccaacttttccaactgggagatattctttatatttcctcgaatttaaaaatcaaattgagagaaaaagagggttgttaatggtggtgtaaattttaactctgcaaaccactagagggaaggaggaatatgacaggatattcaaactccttctccttactggattgagagccacagtgaggaatggaagatgacagatgcttctgtgaaaaactagctggagaacactgtattagaaaatgtataattaataatagtggaattgtctgtggaaacgtaaaatacatttttctggagaactatattgaatttttcctagctaatctccaggttgctttcctatgaaataaaatcattcttctggggattccttagttttatacccacagcaattcaatttcaccattcttaaaaattcccttaacaaataaaaaaatatatattttaaagaaaatcattcggcaaccggttgcggtggcttatgcctgtaatcccagaacttagagagactgaggcgggcagatcacctgaggtcaggagtttgagaccagcctggctaatatggtgaaaccccatctctactaaaaatacaaaaaattagccgggcgtggtggcacgtgcctgtaatcccagctactcgggaggctgaggcagaagaatcacttgaacccgggaggcagaggttgcagtgagctgagactgtgccattgtactgcagcttgggcaacaagagagaaactctgtctcaaaaacaccacaaaatcatttggcaaaatagacataacttataaaatatggcttaaaagaaacaaattttgaacatagtaaactaggagtcagaactggcttttgtttttctctgccactaactagcggagtaattctggacaagttaggaaaaagaagcaattaaaacatttcacaatgctaaaaatatttaagacatgtccaaagtattcttttggccagttcgaatttacaatccctcaaagccttgtaaattaaaaaaaaaatgcaaatacttttacaaatatgaaaagaattataaacacacttgcaattaacattgtgaaatgttagaacccatgactgtggccactgaaaaatgaattggcattagctttctgaaccaatgtttatgttccaaataacttcctgtatttttctgaccactatgtataacacttttatgtctttatactgatcatagtttacctggcataggacttgatccaaaaatagataaacagtctaaaaggacagttaaattaattcgaaaagtaacagactcttcctgaactttaaactcctgaaatattccagcctatgaaaagagtaaaaatgaaaattgttacataaaagaataaaaactaataatataaggtcctagatttcactttatacgtttaaaaaatacaatactgtgctaatcccatgagaataatttctgattagcaatcaaaacatcttagagacatcctttgaagcatccttatctccattcctggatctaaaactatccctctgtgactctcccttgtctcgtttttgtgcctatcactactgctaaggtcacttggaaaatagacgaatgacttgataatgcatgagcaacattagtttcaacttttattatgattttttattgatacgggggtctcactatgattacccaggctggtctttaatgcctgagctcaagcgatcttcgtgcttcagcctcggtctcctgagcagctggaaatacaggtgtgagccaccataccatgcccctgcatgaggacaagaaccgtgtcttatttacctctctatccctgagatcatgctgtgcacttacgtgttaaaaaacgcttagttgaacttgcaatcctatctgaaccacacaaatattactttggaagaacaaaaattctattacaaccagtaaaggaaaaaaatactctttagtaatagcatatcgcagtggaaaaaagagcatatattctggaaacaaatattcagcgttcttatcccaattcagccacttaccagctgtgggactgttggcaaatcacttaaaattgtgcctcgtttccacatatataaaacgggaataataacagaacctaccttacaggactattgttaagattaaataagttaaacaataagaagactgtagcctagccaatagcctagtttaataaactttagtcattactaaccattatctctgtaaaacaagatgggaaaagaatttgttaccgggagagaaaaaaaattcaagtaatgacgttttgttctctaacttaagactattatttatttattaagttatttattatgactattgacaagttattatgactattaagttattttgtctactgaaaccttccgatttcattaaattacatttagagtatctatggcacaggcttaaaggcgcctacttccatacctgaataaaagcatttgcttgcacacactttgcattttccactgttactttgataccatttttagttgcgaaacacgtggcatgttctcggaaatgaatagctttcaagatagtggagagattcctaacgttgtcaaggctggccacaaggctgtactgatcatcctcgtcttggatctgttgggtcagaaggggcatcgtccactgcgcattcggccccgagggatgctcctggggccaacaacttctcggcggatcgccaaacacctgaagggattagacagtaaaactcccatcagtgctggcgaggtccggcgagctccacctgcgctgagaggtggaaaggggctgggaggctgaacacggctgaccaggccgaaccccacctatgtcacttaactatctttgtaattctggaggaaaattatctaagctacggtttcctcgtctccgtaagaggacaataacgtgaaaagttgtgaagaatgaagacacgcaactgacacggtatctcccggccaaacaggagctacaaatccgcggggagtcggttttgtgcagcccgcgccaccagccccgcctccaacaaaacaggcgatggcggggcgggcccggagtgtccagataatcctccaagagtcccagacaaccccattcaccagcccgcccgcgggacagcatcgcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagag

SEQ ID NO: 190 - DNA, 6461 bp, Homo Sapiens
gggccggcaggggcggtgcgcgggaagggaccccggacccggaggtcgcggagagctgggcagtgttggccgctggcggagcgctggggcagcatgaagtgcctggtcacgggcggcaacgtgaagggtgagtgcaggtcggcctggcagcggcggtgcagcagccgcggagccgccagcctaacccccttccgctcttctccccgcagtgctcggcaaggccgtccactccctgtcccgcatcggggacgagctctacctggaacccttggaggacggggtgaggggctagggtgtggggggcgggtgggactccagccgggagcgggtaacccggactagagtctcgcccccactaggcgggatgaccgctggcagatttgtcggcaaagtttcagtttcttagtctggcggctgtcatcttcccaggccggtgtgtgaattgaggaaagctgtcctgcgagctcccagggggtgacgtgcacttagagaaactcggggaaggcctgggtgtgcgacccctcctctgcggcagcagcgccggggccgactctgaaggcttccatggggaaaggagggtttttcagcaggtggtggcggagcgggaggacgatagggcaagtgtgtgagcagaagcagccagagggctgggtctgtggctgccccctgaccacgtccctctccctgctcttcgtggcccagctctccctccggacggtgaactcctcccgctctgcctatgcctgctttctctttgccccgctcttcttccagcaataccaggcagccacccctggtcaggacctgctgcgctgtaagatcctgatgaaggtgaggcccttccctcagcagtggcactactccaccccaggaatctccaccagctgtgcctctgccctggggtactcagtagatgctaagtggggagagagacacgtgcaagcccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcgaaaccccgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaaaaaaaaaaaaaaaggtaagcaggtctttcaaggcattccaagcataaggaagagcatgaatgaggcctagaaggatgccagtgcccgaggtgacgtgggagcccttttcccagagttacatgctgggcccatgatgggtgtgggcctgcatgggacaggagagcttgttgcagagatgtgatgctaggctgaggtgtcttatcccatgcagtctttcctgtctgtcttccgctcactggcgatgctggagaagacggtggaaaaatgctgcatctccctgaatggccggagcagccgcctggtggtccagctgcattgcaagttcggtgagtgggcagccggccagccaaggggtgcctcagcagggaggtcggcgaggcccactgagaccctatcgcccatccaggggtgcggaagactcacaacctgtccttccaggactgtgagtccctgcaggccgtcttcgacccagcctcgtgcccccacatgctccgcgccccagcacggtgagcacacccctgccctcagctcagccccgggtctctctcttccttctttggggccccaaggggttgattttagaaggtacctctttcattttccctacagagtttctgtgaacctcaaagacatcccatggcccgctatgtgctcaggtccttacctggctctttaaaggcagacggtggcatggaggaggggcaggcgcctccttgctccattctccttactgttaggagcctgcattctccatcccaaaggtctgacttgactttctggctgctcaaacccattccaactcctcctctagggagcacatttctggcctgccaccaaatctcttgtctggcttgagtaaccttgaaggtctgcccataacctgtggctcagaggctcagaccccttctccggcctgggcatccttccagaggtgttccccattcaacggcagcctcttttcctgactgcccaggatcgaggagtccccaaggccagggcaggaggctggagggaggctgaataatcagctatggggtggagctgttctgggcagtccgagcactgggggctgtctggggccagggaaatggggactccagttgaagcaaacgtccctggcgaggaccagctcagagaggagtgggctctccccctgctccatgctggtcactgcttgcattcaagtggcccaaggtcctgctcatttctcagggtgactgaagatccctttgggtcctgacatctgtttccccaggttcttttgagccagcactgctcagagctcttttgggtagtgagagacgggggccaattccttggtctgcatttagggtggtgtcttttttttttttttttgagacagagtttcgctcttgttgcccaggcaatggcacgatctcggctcaccacaacctccgcctcccgataaaagtgattctcctgcctcagcctcccgagtagctgggattacaggcatgcgccaccatgcccggctaattttttgtatttttagtagagacagggtttctccatgttggtcaggctggtcttgaactcccgacctcaggtgatctgcccgtctcagcctcccaaagtactgggattacaggcgtcagccaccacactcagtctctttttttaaaaatgagcaattgtttctctcgttttgttttgagatagagtctcgctctgtcacccaggctggagtgcagtggtgcaatcttggctcactgcaatctctgcctcccgggttcaagcgattctcctgcctcagcctcccgagtagctgggattacaggcatgcaccaccacgcccggctaatttatatatgtttagtagagacgaggtttcaccatgttggccaagctggtctcgaactcctgaactcaagtgatccactgcttcggcctcccaaagtgctgggattacaggcatgagccactgtttttttttaaatccttgcgcaggggccttgctcatcttttgcatgcttcagttttagtgtatgtgctgccgaagcaagcactctgtctcatgaataatttcaaatatatgtaaaagcagacgcagctcccgtccccacttgacttgaaacaatttccagatgtgatttcatctgtatgtcaatgggtatccttagaggataaggatttcagggctctttctgaaggccgggtttgtagggtggcctgagtgccacgtcctgcctctgggccctctccctggtctgcatggtcaggtgccgcctgccaggtttgagcaaccactgcaaccagtcccctccctgccaccttctctgggcctcatccacggtgcgctaggcctgcgcacatccgtgcgtgtgcatgtgtcacccccacctcaggtcctccgagagcaaagccctgggcagggccaggcatttcgggtaatgctccaccctgttcacagggttctgggggaggctgttctgcccttctctcctgcactggctgaagtgacgctgggcattggccgtggccgcagggtcatcctgcgcagctaccacgaggaggaggcaggtgagggggctggacgtggcctgggacagcagagtggcaggtgggagaggggcggggcccaggttactcctgttcttccccaacagacagcactgccaaagccatggtgactgagatgtgccttggagaggaggatttccagcagctgcaggcccaggaaggggtggccatcactttctgcctcaaggaattccgggtgaggttcctcccaggcgctcgccgtcctgtcctccctgcccagctcagcccagcccggggcctcacctgctacctctttcctcccaggggctcctgagctttgcagagtcagcaaacttgaatcttagcattcattttgatgctccaggcaggtagttcccagccttgggacagggaagggctctgggatggcaggagctgaatgggatgacctagcttgggccccctcccctgcccaggcccgccatcttcaccatcaaggactctttgctggacggccactttgtcttggccacactctcagacaccgactcgcactcccaggacctgggctccccagagcgtcaccagccagtgcctcagctccaggctcacaggtgagggcacctccccccaactcctcctctctccatgtctgtgcactccagcctgagactgcaactcctagcttctgcacctccccgcaatgtgttctctcccgccccttctctttctatcaggccccagcccctaaccctatagtgctcacagctgccagccctgcagactcagccttctcggttagctgtactcagagacccctcccacccagggaagcatccccaaggccctgccagcttccttctctggctgaggccgcccctctgagcctcctcccaggccaaggagggaaagggctgctgggaggcaggagctgcctgggctgggggaagcaggtggctggaagggcaggtgggctggggaggatggcccagtgcactttcagcacaggaagttggggctggcccccagcccagcctgtccctgggctcctgtgctttccagctcctgtcccctgggaaggtgggggcttgggctccatgtggcccagttcataagacttgctgctcctccctcctagctgagctaaggtagcccccgggatgcctccctcaggcccctacctgaattctgatcaaagagattcctggcccaccccctccaggaagtcaccacttaacccctgcatcctctcctctccagccaaatcaggaagtcataaaaccaagagatctccagtggtcgggggccccagagctcccttcgagccctccaaggtggggccctgcctctgctcccccagtcccctccctgatactccgattctgcctacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaaggtagggactggaggtggaggcaggggtgggaggtagggaagggagcagcctccagaactcacttgttctctttccagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaataca

SEQ ID NO: 191 - DNA, 16646 bp, Homo Sapiens
gtatgctcaaaatccagaaagctcttttaaaaaaggtctcaacactttgagatgttagtcttgaaataagttaatgtttcaaattatattcattcctttaaatggattaaattgctatttcttgacccggcaaaattttaccttggtagatcattcaataaagcagcactgtgcccttctctaagtctgtggtgttgtaccggctcctgccatcatttttcacagctctttgaggagcaaagaggtggaggacttggtagacactaagtagcaagttgtgataagaatcagaaacagacaccaacttcttgaatctcaactaaggtttctttagccacattctacacaaagataaaatcttaagccattcattaaaatcttcaaaattatatgtatttgataataaacatcacatagagcaaatggttaagtcactaacacattctctttaacagcaatttcagttttataaaactactttcagatattgtttcattttgtatcatgatttttaagttttctcactgcagctggaattaatttcgttacaatgagaggaggaagggtttaaaaattaaaacggtgtcttctaattttaaaatgttaatttaacaaaatattccatcctatttcaacattattaaacataggccaggcgtggtggctcacgcctgtaatcccagcactttgagaggccaaggtgggtgatcacgaggtcgagatcgagaccatcctggccaacacagtgaaactccgtctctactaaaaatacaaaaattagccgggcgtggtggcatgcgcctgtagtcccagctactcgggaggctgaggcaggagaatcgcttgaacttgggaagtggaggctgcagtaagccaagatcgcgccactagcactccagactggcgacagagtgagactccgtctcaaaaaaaaaaaccaaaaaacaaacaaaaaaccattactaaacatcaaaagaatcattcaaatacactggttttatcaaaaaacatgaaaaagccaaaatataaattttcatgttagctagtcttccaatttcattttatcctaagcaacttaggtctcagttttgtaatgtgacattaatataatgtttatggatgggtgtgatggctgatgcctgtaatcccagcactttgggaggcccaggtgggcgggtggcttgagcccaggagttcaagaccagcctggacaacacagtgagaccctgtctctatgaaaaattgaaaattagctgggtgtggtggtgcacaccagtagtcccagctagtcaggaagctgaggtgggaggatgccttgagccaaggaggtcaatgcggtgagccatgattgtggcactgcactccagtctgggtgacagaatgagaccgtctcaaacaaaacaaaacaagaaaacaaaagataatgtttatcatgtccacctccacaggacaatgagatgtaattataataggaaatatgatgggtatgtttcagggagaatgagcacatctaccagtactgaatcagctttgatgttcagaaacatcaaagaaatatggtctcatcacttaacacagatgataccttagaagtttcgtttgtttctactctaaatagaagggtcttctttccagaacgacagatccgatacactgtggaagaaagaaatataaggaattacaacctaaacccaaaactggccccaggaagaaactagttggaatggcagaaggagctcccagctaagagctgtgttggctgggccagctctctaggcatcaagaggggagtggactcaggtgggcttgagtcctcagcaagagagagactccaaatgctgcagctgtgacaccccacagtgctctgagtaaccaaggcagtggcggcggggtgacagaggctgttctttctgtcactgggctccaaggggcaggagcagcggggtgaacacactgaaatgcaagactgactgtgcgctacaggccgtgctgagctagagcctctgcctggagggaaagtaccaagctcccaggcaacagctttacgaattctggctactacaccaagtctaaatacatgacgattttcacaacatcaatgagaaattgttctttaaagtctgaataaataaattctagcttttcttttcagtgtcttaaaaacaaagcaaaacagacatgagcaacatgaagtgatatgtttatccaactgtgtgttgttgaatcaacttttagttaaaatgttagagagggacaaataagtacagtgtgtcgatgtgcggtgctgtgagggcacagaccagtgatcagaacacaacacctgcggcctctcccatcctgacaaagtctctgcatgccaactccagcgacagggtgctaggacagcgcagggatgaaatactgaagggacacgtcttcatgaagcagatcaaaatgcaccatcttgttattcacaatatctgggaagagaaaagccatgattttagagacctagtgcagcacacacattttgatctctactttttcagaacagccttcccagcctgcacctcctgttttaggcatctgtcttccctgaggcagctgcagagaccacagtctctcactctcactgccacagctgaggctacatcacggccccagcactggcggctccctgtgcgaggagaggaaaagtgaagcggcccaagcccttggcaaaacacccagcaggctggcttcctggcaaaccacattcacccacatgagcatccttctgcagcgaagagcagctcctcaccagtgagtggaggaactgtgctgagaagagccaagagccaggatcccccaacacctggggcaggctgtgtcacacactgctacatgggatggatccctgcatctcaacggtcctgccaatcccgtgagggccatgggtgatggctaaaatccaaggcatcaggcatgcaaccaagcagggaagtaaagagcacatgagggtgggcaggagcacacagtgtgacaaccaccgagagctcggggagctgcagcacagcagccgaggaaagctctccagcagatatgagtgagtgacaagaaaccatgtgtgagcaggctgcagagaggccaatcccaggagatgggaggttggggaaaggaccagaaaggacaagcaggagacaaacattctttaggagaggtggtgcaagggcacaggagaggcagagactgagggtggcaggacctagctagaggaggggacaattgagccgacacctgaaggagactaacagagacagaaaaggggctttgggaagttaagaaggtatgagaagttcaacccacggtgttttaaaaaaaatttttgctacatcacaatttgctggtcttcctttctctgctacacgtggagacaccaaagtgaatgttgggaagacacttggcttagtcaaccacctttgataagaactcttccatgttcctcaacagccttggattcagaaagtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatcgaggttctcagaagcacctttaaggaccctgcactgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaaagggctggtccttgacattgccacctagaatcttctgttccttctctacagcacactgcagatctgaaggggatgaggtgcagtgttggctcaacctccctctcagctcagcctgggagctatgctacaaaacgtggaacttcaaatccaggatgcagtcgcttttaggttgctgtgatttcagtagtaaggtgacaaaaatgccttgaaaagctcttggcaggtaatgcctttctcatgtgtggtcagtagatgaagagtgctggagcaggtgtgtgacctcacaagatggggcccagccagaatcaagaggcaactgttaacaaccagcagccaagggacagatatggggcagcgaatgcaggccagcatagccacagaaaggaaacaagacatcacaagggaaaacttaaatccaagccaaaccgtgtctggcactctgagcaggtcaaattagatgaccatggagaaggtgggatgatctgcacccattctcccgatggcatctccaggtgtgctggccaactgaggcagcacacaacccacctaccaaccagtgtggctgcaggtttcaggccctaacagagtgcccaggggttgtttctctgctgccaccttaggtacttctgaatctaggaaaatttaaaaaaccccactgttctaggaagttaaagtccacataattgagcttttttttttttttttggatttatgagactatatgcaatctgttagactagagttgactgcagtatttagaatatgaaagaatatgaaaaacaaaacagagaagcacactcactgcataaggcctttgtgggatttacttgttgtccagcaagaaactgtaggagcttcctaatatctatgtgcacttcagccatgtgttccacgtttctgtcctcatgggtgctttcagaggctaaaatgataggaatgcatttaaatacaacatcttcccacgtaacaggaaacctggagatactcaatgcattttacttaaataaatgattcactttagcactgattttagcatcctgaagaaatattgcaacttgtaaatgttgtcattcattaagcattaggtcctaactatttaaaatactatgataatttccaaggcatctttatttacaggggacttgaaatataactcaatctccctcttcaggtcaaagaaaattttatttatttgtacttactatgtattttaagagtgaaaatatatacattaactaatacaaggcctgtcattctggagtggaattaaaaaaaaaaagaaaacatcctttctacctctgagaaagtaccaaagataagtcccaccttatgtttattaaaagaaacaaaatgagtgacatcagaatgaatcgctttacacaatattatcaaaggcataaccgtatggatttcactctgctggagcaggatgctcttaactagaaagtaaaaattccttccaactctatgctaaaatctgtgtttatattcaagcagactcgtagtaacttaaatgtgactagggccgattttattggttctggcacacttatgtatcataaaatgattttctcatcatccccaggtgtttctcccctggtcctttacctgctttcctgctcaggcagcccctgctactgtgcagctgccactttccagccatgattctaaccccctcttggcttataactcaccaaactgtccaaccgtcccctctctccccacttgctgaactgactctatcgtcccttattaccttgtatgagataagaaatgtgatcaagtgaaacagttttgcatctgctacactaatttcatacatatggaagtaactgaaggaggagaatataagaacaaatgtatctacctttctgaatccatgccaggtgagaaatagaaatctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacatagtccagtctcaattcctttgttcttcacccaagcatgaaacaaagtcaactgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccatgggcaacagctttcacacaaccagatgacaaagtaccctacaaaacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcacagcaggagagagtcctgcactgagaaggaaccacgggaagtaagagcctcaactaagcagaatgggcaccttgggcaaaaaaaagggaatgaaactttaaatgaaggaaaaagagggacagatctcagaaagtcctggggatgtggtgaggatgcatgttttaatattttgtggttacaaagaatagagaattctagagtcattaaattagaaaactattttggtccactttcactcctacaatgaaacttcctcctaaaagaaccagaaaaaccagccgggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggcggaacttgcagtgagccgagattgcgccactgcactccagcctgggtgaaagagcgagactctgtctcaaaaaaaaaaaaaaaaaaaaaagagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactgggatggaaaggagaaagataaaatttaccaaacagaaacaaagagttaaaaggatctgacagaaaataataaagacagtggagaagatccaagccctctgagtcccagaagaaaaacaaagcactggaaaagaaatgctatcaactacagctcaaaactttcctgaagtgaatgaagagttcggcccacatattgaaaggacacaccacacacctgggaaaactgaccccggatggtcaagacaattggattgaaagaaaaatgggaaaaatccccagggtatttagtccccactttcaaatgaataaatccaagctgtgaaacaaaatcagaatggagtcattctttttgatagcaataatatacaccagcagacaatgcagtgcagtgagccaaactgacattataaacacatgataaccaatgaaatcctattcctgtgagtccttcttgagtgatatgctagagaataggcttttaataaccaaaaaaatcattggagaagttacagcataaacagtgtgagccttattttgacctttagaaccaaaactaaacaacaggaatgaagaggacagaataacgtgtagtaataaaattttatgctctgatgatgtagacataatataaccattacaaaacaggaagggggaaaatgagaagaatgtggaaatcagtgtcttatttttataaaatataaatcaaccatttgtcataaacacacatttaatatgactataaggccttcagaatctcatgagaacatagccatttatttagaaaataaactcacatgttggaaaatgaaatgtccaaatccagaagggtctggggctgctgttgggttaccaggactgaggatggctgagccaaactccacacgcccaggctaccagacttctgccatcccctcatataccatcgggcacccctcttctactcctgctcttgctgcccggggactgtctccacaggtcacaagggactcctttcctttgaagctcctctacccaccccaacaaccaatcagttcttttaattggatggaacctagaagtgaagcatatgccacagtatggtttgaggttttgctaacctatcctggtccactcccgcacctacaatgaaatttcctcctaaaagaaccagtacctgttatttctctttttgatgttgatatctgcccaatgttaaagcctaggaggtctctggaaagccagtgtgtagtctgctggatagcattttgccatctagtactagaaaagtgccacctagcaactggtcttatttagggccattccatcctcacagtgtcacagaaagaaaacagagaaggcactctgtctgcacggctctgtatcagtgttcatgtttactgaatacaatttagtgttccttgttcttattccttaaaattggtgaactctgaatagttttcattccagaaacaaagtttttctaatttgggtgagctcttatttctgagcttttcacattaatagaaaaatagtgccccaaacttacctgttgtataatctactttgaatgagaaatactcattttcaacccttttctttcattaatccaaaaaaatatattgttatatttcctaacccgttttcctacaatctggaacaatagttgactgaaataaaatatataaaacaatctttgtgaatatgctagactgcttagtggggctaaggctaacacatgaccttagctcatttgttccaaacaaccacacacccaagatctgtaaattcccattgttttgaaaagcaatggttttagatataaataaataaatacttatttaaaaatgcaacttgcaatgggcctagatgcacttcaggcttaaatgttctcttgtgttttcttcaaattcctaagaatctcagtaacagaacattagattccaactccctcctaaccattaacacctggtgcctagcacatggtggccttaagtcaatacttactgaagaaactaacaaacaactaattctctgaacactggtcactcatgtctattttaagattcagttatttgggatattatacacaacaacacacttgatttcttaagtatcagggtaagatctttcaatgatttccttaaaatagtcaactattgtttatagaatgctgactatactgggcacctagtaaaaattatctctaaatttttaaaaactgacgaagcccctgtcatagctgcactgttatccccatttggggtagtatccagcactagggtactcactgcacagcgcagcctggagctgaacccaggtatgtggctccaatgactcccctcttccatatcatgactcctaaacatagactctggtttctatcattaggtgaccctgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggggcagcttttcccatgctgttctcttgatagtgagggagttctcatgagatctgatggttttaaaaatggcagtttttcctgtgttcttctctctccagctgccatgttaagacgtgccttgcttcccctttgccttctgtcatgactgtaagtttcctgaggcctcctcagctatacaggactgtgagtcaattaaacctcttttgtttataaattacctggtctcaggtaatatctttttagcagcgtgaaaacggagtaatacaggcacacatcacaaagtactgctacatgatgtggtctgaagacaggcagcatcgacatctcccaggagctggtcagaaacagagcctcaggctccagctcagacctcccaaatcagaacctgcactttaaccagattccaggggattcacacgcatggtagaacttagaagcaatgtcttagaacatgatgtcaattccctccagttcttgcttctttttctgctcctgcatgagtcacatacaacccaccccatcagtcacacctcgcatttaatgaaaggaagtaactgggcatctctaatgggaaggtgggcatttttagtgtgttaagtctacccattttccttaattctactgcctgtaatattcagatacagaattctggatacccaggaagacctcattatgtactttgctacagtaacttgataactttccatttagtaattccagatcgtagtagcctctccacaatatttctatgtttttttaaactccaaaaaagagaaaacaaaacacctctgatgattctaagctacccttctacctctctaccttgctgactcattttcattgaacagaaagaacaaacaaatgccatccttcaattaacagccctgtcttttctctcctgggcctctctgaatttctctggaagtccccagggtatccccagatgaagccagcctgacaactggatcagcatcactgcagtcacaggtgacaccaacgtcagcacagtgcacactgcttcatggaaaacagattttatagattaagttatgaaggaaaagctttgagttacccaggtccaatgacagcattgctcttagtgtgcagaactctagaaaaaaacagtcaaatgtacattttctaggcttcaaaatacttttgtgatttcaaagacctcttgaagctaaattttgttccagatccatgcaacacttattgctgcctactgagtggcaatcccacactgggcagctgggacacaaagatgattaagatggggtttcctttatcaagaagctggtggttcacgagaccttcagagatcttagcaggtgatttaccatgtacactggacagctcagctccatggaggagcttccagaggggtggtggggaaaggtctgtgatgaagcatgagaatggctaagtgccttccagggagatggagagaagaagccatgtgtcaaatggcaaagaaactgaacaaaaaagaagaggcattgtgggggaataccagaacccagcctcgttctgcagggagggtgtggcaatacaacagagatgtggctataaaggtggcctggtacactgtcaagatcaaaagtttatgcttcatcaggtggacagtggtttttagaagattcagggacataaccaagggtgttttttggagcaggataggagggagcagggggaggagggaggggcagtgagtgaaggaagaattcacaataaccccaggtatgaatgaggataacctacacatttcccaccactgtcacacactgtaacatttcgagccatgtggccataggagacttccacaaaataaacagaaaataaacagaaatataaaagtgccccctagcttggtgtgaggtgtgcttggaataaaggctgctatggtgtggcatatctttgtccctggctcactgaaagacacttggcacgcagacaggaaactccaaactcactgtcagtcatatcagtgactcacagaaaaatacgggcacgttagcaggtaaaagatacaatgttccagccgggcgcggtggctcacgcctgtaatcccagtactttgggaggcctaggcgggcggaccacgaggtcaggagatcgagaccatcctggctaacacggtgaaaccccgtctgtactaaaaatacgaaacaaaaaattagccaggcatggtggcaggcgcctgtagtcccagctactcgggaggctgaggtgggagaatggcatgaacccgggaggcggagcttacagtgaggtgagatggcgccattgcactccagcctgggcgacagagtgagactctgtctcaaaaaaaaaaaaaaaaaagaaagatacaatgtttcatacaaaatataagaggaaaaacaggcagattaaaggcaaatataaaagctttcctcaaagaattagagttgaaaagtattggaataggtttctaaatccaactagcaatctgcaggttctcagcaccaggccaggtcctcataagtgggaactcggttaggaggtgcccacctgcatggactgctgcagggtgagctggagaacccacgccgtcccaccaaatacttcagagttcttttctaaagaagttgtgacttacaaggtgattgctgatgtttttcattttttccacaacactcttcatagtcttcaagactggtaaataaatactaacctacaaaaccaatgagaaaaaagcacaagtattaaaaatattaatatactctagtaatgacaagggccccataactaactctagaacacatgcatgctcaaaaactatgggatactattttacaattttctgaataaagttcttttaaaaatataaaaagaaaaccaattctatttcactaactcaaggatgctcaagcaaaattaaagaatggaatgcctgcctctggttacctcagcaaccatgtccctgtgggcattcttttggctcaagaaggaatagggtacttcagctgagatgcccctatattggtccagggggaatataactcaggcaatcagcaggaggccctcctctaagggacatttacacctatgattcaagggccttttccatgctctgtacaaaaacatggcagacagtcactgcatcacatctgagactgttaccaagagtgctctataaaacacaggctttttcaaaatcagtgtaggtgccatctagtaaaagtcaagtaattattttacccagcatatttctgtactttcttcttaaacaaattgtgagcaagaggaaatgggccctttggcatcatctttactttcaggagctctagggttaaccatcggcatgaccgttaccccatgttagccctaagccatgaaattcttctcttcttggctttcgtgcacatccagatatcgctcctgaccggctgaggaaaagatcaagtcctgtgaaacccaaattggtgtctaaggccaagaatactaataaatactaattgtcctccaaaagtatcatttgtgttttaagtgatgttactgagcgagacattttctacatataggatggcatgacatttctatcatatgcaacatttttaagatgctttatgtaaataacaaaaggcaaataatctaatgttttcgttaagtatcctttaaaaataaaatatactgcaagactacaactaaaactagagaattcaagtcatgccatttaatgtggggtgtacagcaggactgcaggcatcacctacatcaggatctgggaccaccggttcttgtaagtccttccacaatttcctaggaatcacctttatggggatgtcatgggtcacaatgcggctactgcttgacatagataactgccaagaaaagaatttaaaaatatttttatgttgttaatattaagcaacaacaaaacaaacccgaagacccgggacaaaaaagttgaaataccaaatctaagtggaatgctgtcagtttattcactcaaaagccattcgaccaatattgatggtgccaatatttatggaacagactctgggtacttccaggaactgggaagtgtggtgataagacaaaaaggtccttagtgttccagtggaacaaacagatcaataaaaatgcaaacaaatgaaactgtatgaaatgctcattatagccgtgagaaagcactccacagagaccagggtgagtgtgggggagtttccttagactgaggaggtgacatttcagataccaccaaaagcaggagaagcagcagccatgggaagacaagaacaaggggacagggtttcaggctggggaaacagcacatgtaaagccgtgaggcagaaagaagcaagcctgctatgttgacgcaaccaagagaaggccattctttgggcataggacactcagagtgctgcagtttctaacagttaaaaggcaaactatatttatttctaggggctcctatgagactcacagaccaaaatatcttgcacttttggacaaaaagtattatacgttactatcttgcttttccttaagcaatagaaaaaacataccaaacttatactgtgacatgaaatgccctaattagctctgagaactgcctgactgcaaagagttgagagttatgaagaaaagctgggctgggcgccgtggctcatgcctacaatcgcagcactttgggaggccgaggtaggtggatcacttgacgtcaggagttcgagaccagcctggccaatatggtgataccccgactctactaaaaaaatacaaaaattagctgggtgtggtggtgggtgcctgtaattccagctactcaggaggctgaggcatgagaatcgcttgaacccgggagatggaggttgcagtgagccgagatcgcgccactgcactccagcctgggtgatagagagactccgtctcaaaaaaaaggaaatacgaacctcattctatgagtaggaagagcaactctggattgtatgtatgcgcatgagtttgtgtatttgtgtgtttggaggacagctgtgcactaaattcatctggcagtagcatataaaacatacgtgtactgaagaacgaggggccatttaaaggttattatagcagatgaggcagggtgggagtggggagaaaacatgtcaaaggtgaaaatggatagagaaaccatgatttctagacaaggtgacaataccactacaagaaacagagaggctggaagtttcacggcttggaaaaagcagcattctagctgaatgcatatgataacaacacaattttaaaatgaggaggaactgactctaatgcaaaatatagttatggaccagatctttaaatttaaataaaccaaacagctttcaacagtatttattgttaaaaaggctaggctaactatgtctattccttcgaggccaagacttctgtgttagaaaccctgactctcctactcaccagctccacggagaccgtgaggcagggaaagtgtttattagtcagtttgattttcaaagccctggcattctgggcagtcttcaaggctcgagataagttttccgatgttagctctaaataaatctcattgttttctgcagagacaccctccatttgaaattcgttgaagaagttctcctaagggaaaaaaaatgagggatgagggagggtatatgtgatctttccagtgacaatctgcagagtgtgcaggcctctcagaagcttttgctcacctgttccagctcacaccacatgctcactcctccattagccagcttgtcacaaaggatgaagttaagcttatcagggctgatgcggagggtgcaggttttggcaagcttggctatcatgttactgattcctaaagcaggggttaaaataaggaattactaaaatgcacattatgtatcctagagaccaacttattttgcagaatttcttgttcatcaacttctcggtggaaaaataaccacttaacgttggtatcacactggaaagtactttaatacccctgatgtcacgcaattctcccaacaaactaggggagatgtacagcacacatcatcagtgttcaaataagaaaacaggcacctaccagtcattcattcattcaacatggatttattgactactaggtactgcaatacacagttaaatgcaaggttaggcactgtcagggtggagggacgaatggggccttgaaggtatgtcaatgcctgataaagccgtctatgggagcagtggccgcttttttttaaagccacgtgatcggaatcaagtttcagaaacgtcccttgaaagccgccttcatccccacaagtgccctccgacccgccccgcgccctcccggccccaccctcccgcggcctacaccagcacccccatcccggccccatcctcccgcggccccttccggcgcccatccccgttctgatcctcctgcgcggtccccaccgcgcgctcactgcttccttccgttcctccctcgctcctctccggcctccctgctcacgtgtgaagtggttcagacaggccccgtccacgatcttggcccgaaacttcatggccgcggatggcgcagccgcggcgggcctctgtgggtaacagaaaagcgtcgcgccctgagtgtccccgcccggaaacacggcagcgcgaacagtggttccgccc

SEQ ID NO: 192 - DNA, 45505 bp, Homo Sapiens
gcaacgcccgcgagggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccggtgagcaggatgttcggaagcaacatggtccccgccgcgacggcttcgggcgcctcgctcacgtgccctttgctctacagggaggagccggaaggggcgggcggcagcaaaagcccacggccccaaaggccccgaagcccaccgcggcgcccctagcctgccccggcggcccagccgcggcccactggttacctggctttcgatgacacatttccgtcgcaaagttggagggtgggcataactcgggtcggtacttcgggtcaggcagtgcgctggatgcctaagtcacacactccttcggtggtccccgcccttcgcttgcgccgaccagtctggaaggtccccgggaggccgtacctccgagaggctcggcgttgagcccgggtagggccaggtggctgccctttcacctagggtagtccctggtcgcctccgctcttcgcctaaaaggggatgcagctccgggaaagtaaggccgccgcggttgcggctatattatgtatatgtcttagagacgtgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggaggtaattgtcaatcttgttttcaagagtgaatagagacctgaccgtgacaacagtctgcacctttttttgtttgtttgtttgtttttgttttgttttgagacggagtctcactcttgtcgcccaggctggagtgcaacctccgcctcctgggttcaagtgattctcctgccttagcctccagagtagctgggattacaggcgcccaccaccacgcccggctaatttttgcatttttaatagagacggggtttcaccatgttttggccaggctggtctcaaactcctgacctcagatgatccgcccgcctcgtcctcccacggtgctgggattacaggcatgagccaccgcgtccggcccctggtctgcatcttttatttcgagctacaaactatatttactcaaataggtgttttttttccacctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaaggtaagtacatagtatgtgtggtttttttgtttttttttttctaatacatcattgagttcatgtgaaaaactcttaacaccacaagtagattatttgatacagttatagtcattaaaattattttagaattttgatttcttgtatcacttaaatttactgttctttttcactagttcttgagcctttattgtattgttgattatatcagtatacatttattactataattgggcatttacagtttttcttcatttgagggcttcttcccccccccccccccaggtgaattatagtttaatgtactgcaagtcctaaactacggatgggaactattacagtttataatgtcaaaaacttttcttagaccaaaggtatcttccacaaaggtatgatacactggaatggccatgtaataattgccttaaaataattataaatttttatatatattcttaataacttattactgctatcaaagtaatagagccgagtatctattgtaattaatgatttaagcaagtctggtaataagttgtgaaacaagtgttctctaaaagcacaaccttaattttgaaaaagtgttttacagtcccagtcacaaaggctgaaaacatttgaatgaaagaacatagaagagagaaatatgagtggtagttggtgttatagcttaaccaaaagcactgcttcttagaagtaatgtaattcagtgtgtgagttctcagcaagataggggttaaggtgggatgggggtcagacagtttcatgcatgcagggtagctatttccctaagtggtagctctaaattttctttgatgttaagtaagttacttaactttgctgtttatctttctctttttttcagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtagctatgactaaaattttttccagtggtcttccttttttaatccactgccgataatattcctaactctgtcttaaaagaagagtgaagtgtgacttagcattcgtaaagtatttataagccccaaattgtctcccctaagcctactttcagctccaacttctggttcattttcttcaagagaggaacattgtctaataaatagctcaactgtggctgagtattcttgaaagaaatatataacttggtttctttttgttagccaggcagtagattctacaaccagatctgaagctatatttttctagatttatgctattagagtgttaaaaaatctagtaaaaatttctaatttctaattatttgtaattattagctaataatttctaattattagcaaaattttttttttgagacagggtctcactctgttgcccgggctggagtgcagtggggtgatcatggttcactgcaaccttgacctcccgcgctcaagtgattctcccaccttagccccccaagtagctgggaatacaggcgtgcgccaccatgcctggctaattttttattttttgtagagttggggtctccctatgttatgctagctgttctcaaactcctgggctcagcaatcctactgcctctgcctctgaatgtgctggaattataggtgtgagctaccacacccaaccattcccaggcatttctgagtgacagttccccctctggaaagcctgcctcaattataaaaatattagttgcttcatacactgaagaaaaatataatccagtcataattacagattacgttatgatctttggcctatatcttcactaagtcttcaagctgatacggattatttggatgtatgaaatggttcttagtttgtgaatgtattaacctggccaaggcagatatattactcttattgctgtttctgttaaaatattatcatttgtttattttgttttgctttttttaataggtaattttaatatttatgtttcaatcctacagagagtttaaaaaaatcattctagtgtttatgctgggaaggttacaattaataaaaataagtttgtgttctttactcctttaaggtcaagtagacaagtatgcacttgcacttactgtaaagtagaaaaacaactattacagacagagttttatttaaaaagagttaatttgtaagatttttaggccgggtatggtggcttatacctttaatcccagctctttgggaggctgatgtgagaggatcacttgagcccaagaattgtttgagaccagcctgggcaacatggcaaaaacccatctctacaaaaaatacaaaaaaattagttgggcatggtggtgcatgcctgtagtcccagttactcaagaggctgaggctggaggattgcttgagctgagattataccactgcagtccagcctgggtgacagagtgagacccggtctcaaaaaaattttttttttttttttttttttttttttttaagttttaaaggttataaatatatgaatatgttgtttccagagtagttcagttatttgggggaatagatgggagaaaatgtgattatatttacatgatttctttttttttcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcaggtactgaaaagcatgcagacatatctacataatttaatttcagggtgcataagggtagatgggaagcagagggatttacattttcagattttttactcataagaatctttctaagtgttagaaaaaattctggatttttttattttccaaggcttagatttttctcaatagttattctaaagttgtatgattagttgtcttagatttaatttaatcccaacatagaattgatctttttaaaaatttttgtactaaatgtaatactcctctctactgtcttctcaaaatgtatttctgaattttaaaaaatgttataactgcaaacttgccaaaattatcatacagaggtatcaacttaagaatataatttttccataatagtataaaaattcaagtataatcaaaaggatcattttattatatagattgttactgatttgctacttcttttcgttaataatgcttaggttcatatgtgctgatgtaccaaaaaatcttcagttaagaagttttgttttaaatttgaaatttttgttgtagcatgaacttgctgtgcataaaaagaaaattgaagaagtcgaaacctggttaaaagctcaagttttagaaaggcaaccaaaacaggtaactaagaaatgtgtttttaaatatttaacatcaaatatttttctgacttacagtgtgttgttagaagttaaagttttatgatgattttgttcaaaataagtctagatctcctgcagtagaaagctccctagtggggcatggtgactcatgcctgtaatcccagcactttgggaggccaaggcaggaggatcacttgagcccaggagttcgagagcagcctgggcaacatagggagactgtctctacagctaattagctgggcattgtggtgcatgcctctggtctcagctacttgggaagctgaggtgggaggatcgcctgagcccagaaggtggaagctgcagtgagctgtgatcacactagtacactctagcctgggcaacagagcaataccaaaaaccgtaaaaagcaaaacaaaacaaaaagcgaaaaagaaagcttcatgactttactacttccaacttgactaaaagactcagagactttgagttttcccctttatttgtaactctttttctttatgtcttattgttagcataaagaatcagtaaaccaattagggtgctagtgtatttagcacatcagattatctcaggctgaggaaagcaggcaaattacatgttagtttctctactaaatatagccaaaaacagtcattatttattttagactgatattttttgtttcacttccttactgcacaattaccttgaacccccaaggtagaatattctctccttccatcagtctccctttttaaatgttttttattttgagatttttcaagcataaaagaaaatagaataataaaaaaatatatatagaatatactcattgtttcccccttaagtattttaaagtaaattataaacattgtgacatttcagttagacttttagatacttcagtatgtctgtttttttaaaaaaatgattttcctaattaattatgcataccattattctctctaacaaagttaaccaggatgccgtaatgctgtctaatgatgaattcatattcacgtttctgcatttgtccccaaaatgtcttttgtagctggtttgtttcaaacaggataggatcacacgttgcatttggctgttatatatcttaggcctttttttttttccctgaatctaataatagtttactaaccctttcttttctccaaggcactgacttatgaaggagaccaggccggttgacttgtagaagtctcacactggatttgttaggttgtttcctcctaataatgattaacttattcgtctatcctgcatttcctataacctgaaattttgaatcaagggcttgattagactcaagttgaacatttttgcaagaataaaggtcatgttgtatgttgtatagggcgtcaaattggaaagtatttgtggttctcctgctgtcttaagtttggtcactagatcaaagagatgaaagtcaaaaatcttcattgtagagtaactttccctcacaactgacacataatccatggggagataccgtggcagcatgtgagtgcccagttctccatcagtcgtccacctaagtgctgtagcttcagtttttcaatccttgcctgaatcacttattttattagagttgtacagtagtgactttcttatagttctgttatttctacagttattactggcatttttctacaaagaaaagtttgccatcactagctagggttgtttagttaccttgaaatacatttccaactagaaaggcaggataagttttgtatcttttccttttttaaaaaatagacttatttttggagcagttttaggttcacagccaaattgggtagaaggtacagagatgtacctcatatcccctgccccaacacatgcatagccttctcccgttactaaccttccctcaccagagtagtacatttgttaaaactgataaacctacattgacacatcactaacacccagagtccattgtttacattaggtctttcctttagttttcaaccttgagatgaaggagttggtgttttagttgctttgatggtaacagatccttctctcttttttttttctcgagagtcttgctttgtcacacaggctagagtgcagtggcatgatcttggctcactgcaacctctgcctcctgggttcaagcgattctcctacctcagcctcccgagtagctggaattacaggcatgcgccaccacacgcagctaatttttgtatttttaatagagacagggtttcaccgtgttggccaggctggtcttgaactcctgacctcaggtgatttacccgcctcggcttccctaagtgctgggattgcaggtgtgagtcatcacgcccagccaatcctcctctcttgaaccaagctcctttctctctggcctgtggatctaaaccttttggtttagggctaagatcatgaattcaagttggattttcagtgtcagcattggtattcctctgatgtttcatagaaatctcgtctcttgtctccgaatacagatttttgggcagtctatctgacacacctcttacatccaggctttttctcattgatttgtttttggtcagcttagctaatagtttttatttttcagtgtccattgtgttttctcacttagcaatactctgtcagtataaacattgtcacatcataaacctacattggtgttactattattattctaccagttggataaacttaggtatatgtgtgtgtgtgtgtgtgtgtatatatatatatatatatatatatatatatatatacacacacacacatatatatacgtatatatatgtatatatacgtatatatatgtgtatatatacgtatatatatgcatatatatgtatatatatatgcatatatatgtatacatatatatatgcatatatatatgtatacatatatatgcatatatatgtatacatatatatatgcatatatatatgtatacatatatatatgcatatatatatatgtatacatatatatatgtattgggaaaagtattttctttatggtttcaaaagttttccccctaaggagttggactttaatcatatactctgtttatttgtttattaattttttagagacagggtcttgctagagacggttgcctacactggattgcagaggtgctgtcatagctcactgcagccttgaactcctgggctcaagcagtcctcccacctcagcttcctgagtagctggggactgcaagtgtgtgccaccgcatctggctaattaaaaaaaaatttttttgtagagatggggtcttatggtgttgcccacgctggtcttgaattcctggcctcaagtagacctcccacattggcatcccacagtgtcagaatcaataggcatgagccacaccatgcctggcccaaatcacttaccatttattttacagaagtttcagggatgtcagtaattagaaaatgtttttattcaaaaaaattggtaagatctagatttatcaatgggcaaacgaaatttacttttcaaaatttattttaaatacgatataccaaatatttgcagagtttaatttttcaggacagcttctttccttcaaaattcagtaaaactctgttacagtgtagacaaatgggattaacaagattcttcacattataatgtcctgataagaaactacctcctagttctcttactggaagggaaacttgctatgtggctgtacccactctgtcagaaaacaggcacttaagtatattattacatgagaaaaatgtataatgcctgtgcataggcttctttttctttgtaaagaagtgatctgtctggtattgtagttctcattattcaaggtagttatgttctgtaaagttgctgaattagcaaatactgaaccattattctaagaaaaacactaaattaggtttttgcaaacctctggtaacaacatttttgtcaacccatcaatatatagccttgttgtatatgtgtttttatttaaagttatttaatgttcagtcatgcttcaattaatgatggggatacattctgggaaatgtgtcattaggtgacttcattgttgtgagaatatcatagagtgtacttacacaaacctccacctaggctatatggtatagcctcttgctcctatgctacaaacctgtatagcttgttactgtattgaatactgtaggcaattataacacagtgggaactatatgtgtaaataaacatacctaaagcataccattaaaaagtacagtaaaaaggccgggcttggtggctcaggcctataatcccagcactttgggaggtcgaggtgggtggattacctgatgtcaggaattcgagaccagcctggccaacatggtgaaaccccatctctactaaaaatgcaaaaattagccaggcatggtggtgtgtgcctgtagtcccagctatatgggaggcacaagaatcacttgaaagcgggtggcggaagttgcagtgagctgagatagtgccactgtgccccagcctgggcaacagaacagagactttgtctcaaaaaaaaaatattttttggtaaaaacatggttataaaagataaaaaaaatgctagtatacatttatatagggaacttaccatgaatggagcttggactggaaaatggttaagtcagtgactgtgagtggttagtgacagtctaaggacattactgtgcactattgtagacttttataaacattgtacacttaggctacactaaacttaaacagttttttatttaataaattaaccttcacttactggaactttttgtaaaggccatgtgaaggactttatgtagcttttttactttataaacttttagattctttgataataacacttagcttaaaacacaaataaatggtacggctgtacaaaaatattttgtctttatatctttattctataaattttttttgtatttaaaaaaaaatttttaagcttcttttaaaattagaaatgaagacacaaacacaccaattagcctaggtctacacaggattaggatcattaatagcactgtcttccacctctatgtcttgtccactggaaggtcttcagaggcaacaacacgtaaggagctgtcatctcttatgacaacagtgccttcttctgcagtacctcctgaaggacttgcctgaggctgttttatagttaacttcttttttttttttttgacagagtttcactcttgttgcccaggctggagtgcagtggtgcaattttggctcactgcaacctctgcctcccgggttcaagcgattttcttgcctcagcctcctgagtagctgggattacaggagtgcaccaccacgcccgggtagttcttgtatttttagtagagatggggtttctccatgttggccaggctggtcttgaactcctgacctcagatgatctgcctgcttcggcctcccaaagtgctgggattataggcgtgagccactgtgcccggccaacttttttttttaaaaaacaagtagattctaataataaagatgggcactgtaaatacataaaccagtaagatagttgtttattataattatcaagcattatgtgttacacataatgagatatacgtgttacacttttatacagcacagtaggtgtgtgtacaccagcattaccacaaacatgagtgatgttttgcattattgttactaggaatttttcagctccattataattttatgagactactgtttatatgtggttcatcattgactgaaagttgattatctggcacatgactgtatattgttgatccatatagtttgaactcatggtgaacagcgctataactcatgcactgcccctttcaaaagtggagcaggctctctttgtccaagtacataggttcttattaaaggaaaataaacaagaattatagcctaccattgtatgtaggaaatcttttgatatttctgtagcttcaacttttttttttttaatcaaatttacggtatgagggaatgttactgggatccacaacctctagtctctcgttagagtcctatctctggtaaatatgtttcttttttttccttttttttttttctgagacaggatcttactctaatgtgcaggatggagtgcagcggcaatcttggctcattgcagcctccacctcccaggctcaagtgattcttccacctcagcctcctgaccagctgggactataggcgcacaccaccatgcccagctaattttttgtattttttttgtagagacagggttttgccatgttgactaggctggtctcagactcctgggctcaaggaatccgtctgcctcagcctcccaaaatgctgggattacaggtgtgagccgccgtgctcttcccaaatatgtgtcttaatatgcatttcttaaagaatctaataaccaaactgaggtctttccataagaatattgtatttgtataacagtaacttatatcatccaatgagatgtctatattaagaataaattttgctgggagcggtggctcacatctgtaatcccagcactttgggagaccatggcgggcaaatcacgaggtcaggagattgagaccatcctggctaacacggtgaaaccctgtctctactaaaaatacaaaaaaattagccgggcgtggtggcgggcgcctgtagtcccagctactcgggtggctgaggcaggagaatggcgtgaacccgggaggcggagcttgcagtgagccgagattatgccactgcactccagcctgggtgaaagagcaagactcgtctcaaaaaaaaaaaaagaataaattttatgagttcaggtaacctctaaaaatctttgtttcagacatcacctccctaatttagccaaagtttagtatttggctactaaatagtccttgagagggacataatgcaaaaattgagaaattatcagaagcggaattgagagttgaagaattaagattctcttatttccatatttgcagatgtttttgtatggaaaaggggggaaaaaggcaatttttaaaaaagaaaaaaataaagctggtttattccagcaagcattattatgaaatttaatgtgcttatatgagacattcagcaaatatttatagaagtaaatatatttagaatgaaaagtcagaaataatattctagcattccagtgattttggtttttaattcatatttgtatttgattttagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactggtaagatttgctgtgaaggtagtagaagtagtggggcaaacctgtgcttaagggagctttcagataaagttctatgagtgcattttttcccatacttcttgctttcagagggatggaatttcacaggccaggtgcgatggctgtcacatgggaggctgaggcaggaggattgcttcaggccaggagttaaagaccaggctgggcaacatacaaagaacctgtctacaaaaataaaaaaatcagctaggtatagtgttgtgtacctgtagttctaactactcaagggctgaggtgtgaggatcacttgagcccatgagttcaaggttgcagtgagctatagtgttaccatcgtgctccagcctgggcaacagaatgagacattgtctcaaaaaataaataaataaaagttatttcaggagaaggaaagaaagcatgtctccaatggaagacaatggaattttttgaagattaagtcttaactgttttgttaacatattcttctgtttgcattatttatctgcttttttctaagatctggctaggaggttagacagtattaactaagatattttatttgttaaatcaagccttaagatgtgttaaaaagaacttgccccccaacaagatagcttagatcagtaagtacctgttagaacaatatcaaatgaaagcaaaagacaaagatgtctttggaatttggaaggaggccttaagataacgatttaaaaattgataatagtaacaattttatttatttttattttttttgagacagagtctcactctgtcgcccaggctggagtacaacctctgcctcccagactcaagctattctcatgcctcagcctcctgagtagctgggattagaggcatgtgccaccacacccagctagtttttgtatttttagtagagatggggttttgccatgttagccagtctggtctcgaactcctggcctcaagtgatccacctgcctctgcctcccaaagtgctgggattataggcgtgagctaccatgcgtggcaatagtaccaatttaaagatgtaatacgttataagttcatgcatatgcttatgtaccttagcactatcatttttatctttcatagtttttcatattgcaactccaggtggtgaaactagggatagccaaatctcctaggccattttgaagggaaaagggttctgtagaaggataattttaatgtggagtgttcctcaaaatcccttctctggactcttctttaatgtactcccttgtgctactagtatcccatcctgctggggcttttactgttttcttttctttattattattattactattattattattttttttttgagatggagtcttgctctgtcacccaggctggagtgcagtggtttgtctcactgcaagctccgcctcctgggttcaagcaattctcctgactcagcctcccaagtagctgggattacaggcgtccaccaccatgcccggcttatttttgtattttttagtagagatggggtttcaccacgttggtcaggttgttttcgaacccctgacctcaggtgatccaaccacctcggcctccaaaagtgctgggattacaggcgtgagccaccacgcccggcccattattattatcatttttttaagagagaaagtctcactatattgtctagaatgaacttcttaagcatttaagggattctcacgacccaacctctggggtagctgggactacagacgtgtgttcctgcatctggcttttactgctttctaaatagtagcattacttttgacagtctgataagctttaacttaaacagtcttcaatatgaaacatgccttcagagagcttccctcattctcaagttcactaatcagttattctgtttttgttgttaaacctttatcactccagcctgaccaacatggagaaaccccgtctctactaaaaattcaataattagccaggcgtggtggtgtgttcctgtaatcccagctactcaggaggctgaggcaggagaattgcttgaacctgggaggtggaggttgcagtgagccaagattgcgccactgcactccagcctgggcgacagagcaagattccgtctcaaaacaaacaaaccaaacccttatcactgaaggtaattcatttataggcttgaactcatttagagattcttcattgggtaggccacagtcatagatatttttaccaattatatgaatgttataccgacagctgtgttcttaggtcagttaactccatattacacagggtctcactctgtcacccaggctggagtgcagtgacacaatcttggctcactgcaacctccacctcctgggctcaagctattacccccaccctctgcctcagccctgcaagtagccagaactacaggcacaagcctccacacctggctaatttgtgtatttttttgtagagaccgggtttcaccatgttgcccaggttgctcttgaattcctgaggtcaagcgatccacctgcctcggcctcccaaagtgctgggattacaggcgtgagccactgtgcctggctacatgttgactcttgtcctttgaaaggaatatcctattttaaatttaaatgatttttcctaattgggaaatagtctacagtattgtgagatgcatcaagtatgtgtgtgtgtacatacagatgtataatattaatgtatatcatttgttgaaaataaaagtggttatgtgtttcctttcagaatcaagcttccatatgtttccctatcagtctcagatagcagttttcaaagagtttctactaagagcgacaaagtataacaagttacaaatgcttggagatgatctgagaactgataagaagataattctggttgaagtaaggacaacttttaaaatctttttttttttttttttgaaatggagtcttgctgtgtcactgtcacccaggctggagtgcagtggcgcgatctcagctcattgcaagctctgcctcccaggttcacgccattctcctgcctcagcctccggagtagctgggactacaggcgcccgccaccacgcccggctaattttttgtattttttagtagagacggggtttcactgtgttagccaggatggtctcgatctcctgacctcatgatatgcccaccgtggcctcccaaagtgctgggattacaggcgtgagccaccatgcctggcctaaaatcttttttttttttttttttttgagacagagtctctctttaacccctaggctggagtgcagtggtgcagtcttggctcactgccacctccgcctcctgggttgaaacaattctcatgcctcagcctcccccgagtagtggggattacaggaacctgccaccatgccggcctaatttttgtatatttagtagagatggagttttgccacgttggccaggctggtctcaaactcctgacctcaaggtaatcctcccgccttggcctcccgagtgctgggattacacatgtgagccaccacacccagccaacttttaaaattttgctgtagctattgactaaacaattgtgagatatatcttacatgataatgttaacttgtctctatagtagtgatattggtaaaatacaacacaaaggctttgtaatagtagaaacctaaagtctcttctagtaaacttgaatggaatagctgtaggataaggaatgttataaattttaatggtttaagtatagaaaaacaaaagaaaagtttggaaaattacttcctagtgaaaatactgtaactggaaagcaacccaaagaaatttgatctaaaaattgggatccccattgatgtatattactgtttcggatatcatctatttcatgtttcctgtgaaagttctgtttaaaatacattgaataaatatatttttgcctacctcaataaatataaatttgaaaaataaatttgcaatggaataaaactatactattatttattttttattttcaataggatttacctaaccagttttatcgggattctcatactttacatgaagttctaaggtaggtttcagtgaagtattctaaaactccaaattaaatgagaagtggcttaaatttcaacattgctgtattttgttattttaggaagtatgtgaggattggtcgatgtcctcttatatttataatctcggacagtctcagtggagataataatcaaaggttattgtttcccaaagaaattcaggaagagtgttctatctcaaatattaggtaagaaagaaatttctgcttataaaggtcacatacatattatatttttaaattaatcatttaactgctatctttctttataaaacttagtttcaaccctgtggcaccaacaattatgatgaaatttcttaatcgaatagtgactatagaagctaacaaggtaagtctctgattaattaaaccttactcgataactatagaaagcctagcttaaatagtattatgtaaactgaaggagtgttattttaattttttagaattaaaacattttattatactcataaggcatgtcattttagcaaatgtaggaaatactgattttaaaaatctttaacatttttctactattaaactttcactttcacattgaggtaaatttttcctttgcttggtttactgttctaaattgtgtctgtcatcaagaaaatgttttctggcatgtaggtatggtagttatcaacaattcaactcttcctattgtcctgttgtcacttttttattttcacattttttttaattatggtgaaaaacatgtatcataaaatttatcatcttaaccattttcaaagatacacttcagtattgtaaagtctatttacattcatatacagctgttgtcactttttttttttttttggagacagggtctcactctgttgctcaggctggactgcagtggcataatcatggctcactgcagcctcgacctcttgggctcaagtgttcctcccacctcagcctcccaagcagctgggactacaggctggtaccaccacgcctggctaattttttaattttttttagagacagggtctctctgtgttgcccaggctggtctcgaattcctggctcaagtgatcctccctcctcggcctctgaaagtgctgagatttcaggcatgagcctctgtgcccggcttcttttcacttttagtacgtcattttttctgtatttcaaatcaagatgatgttaaaaaaaaattgatggaccttctgctcccagcgtcatggttttagggaatcctattggtataaatcaaccaaatcttgcatgaaacataatttttgttgcactgctaggaccacaggaactgagggaaatatccaagggagaggttgttttgaggattaaatacgttagtgtagagcacctaactgaataaataacagatattaatagtgaaaaatgagaaacaaactgagtccaataatacaggaagcaattactgtgatgaattattatgctattagtgttttgaaaatatttaatgggtcaggtgcggtggctcacgcctgtaatcttaacactttgggaggccgaggtgggtgtatcacctgaggtcaggagttcatgaccagcctggccaacaggtgaaaccccatctctaataaaaatacaaaaattagccggatgtggtggcgggtacctataatcccagctactcaggaagctgaggcaggagaatagcttgaacccagggggtggaggttgcagtgagccgagattgcgctacttcactccagcctgggcagcaagagcaaaactctgtatcccaaaaaaaagaaaaaaaattacctgggcatggtggtgtgctcctgtattcccagctactcagaagcctgagacaggatgatcgctggagcctaggagtttgaggctgcagtgatctagatgaaatgactgtagtctgtcatggacagagctaaaccctgtctctaaaaaaacatctacattctctactataagcatgagaactgcaaattgagccatggtgcatgcctgtagtcccagctacaaaggctgacagtggtgggaggatttgttgagcctgggagctcaagaccagcccaggtgtgatatagtaagaccttgtgtcaaaacaaaaattttttttttagtgaattgattagttcaagtggctctggtttaaaaaagaagaagaagaaataattggtgtaattatggctttttcatcctcaccagactgtataatgtataaccccagtaaaggaattttcatgtaaatttcataaattagttagattattttgtgtatatttaattttatcacagtctgttgcattttgagggtttttttgtgtgtacacatatatgttgttatatatctgtgtgtatgtagtgagaaagagtaaaaacttcaaaatacaacctggtcaaagtgaaaaagtaaaataatacagtatttaatatttcctgaaagtataccttaaactgtaataagtcattgaagcttgtatcattcatagaccagtgtttagcatgaaggctttttagttttttattactattttaagataattttttttttctggctctattgcccaggctggagtgcagtggcaagatcatagctcactgcagccttcatctccaggtctcaagtgatcctcccatttcagcctcccaagtagcagggactacaggcgcatgccaccatgcccagctaattgttttgattttttgtagagataaggtcttactaccttgcctaggctggtctcagactcctgagctcaagtgatcctcctgcctcagtctcccaaattgctgagattataggaatgtgccaccgtgcccagccctttttagtatttaagtttaaaagaatctaatttacgttaattaagtttagaaaataggttggggttttttgttgttgttatttttaagaaaatacttttttttaaatttaattttcttattttagaatggaggaaaaattactgtccctgacaaaacttctctagagttgctctgtcagggatgttctggtgatatcagaagtgcaataaacagcctccagttttcttcttcaaaaggtaactatggaagatacagtcatgtggcattatataggtgactgactttctcttaattcattcaatgaaatcaaacattttaacttacatttggtctatacctatttatccttctttattactgagacagtggcttaaaattaaatatatacacatgcatacatacccttctatgaatatgtcgtagtatatatccttgtttctgtttgagatagtttacctttcaaagttaacttagaaccagatttcctggataaaaattctgcctctgccacttaccagttatataggcctatgcaggtgactcttatctttctgtgcctctgttttctcaccttttatgtgagcacttacctcttagggttctatgaagaatatgtgaggtgacactattatagagtgcttcttacagtacttgattcatattaagtgttcataaatggccagccattaatcagtttaataatactgtgccgaggtaggtttacttttggaattattattatttattttgagacggagtctcgctctgccgcccgggctggagtgcagtggcatgatcttggctcactgcaagctccgcctcccaggttcacagcattctcctgcctcagccttctgagtagctgggactacaggcagctgccaccacgcccagctaattgtatttttaatagagatggggtttcactgtcttagccaggatggttgcgatctcctgacctcgtgatccgcccgcctcggcctcccaaagtgctgggattataggtgtgagccacctcatctggcctgaaattatttttataataatttatgagatatgtttaataaatttatttcctgttaatgttaaaaagtataaatttatgagatatgtttaataaatttcctgttaatatgtagaaagatgtagtaaaaagatagtttcactaatggcagtgagttacatttttactgtaatggtcatcgtttactgcatagtcctccttcagaaggcatttagcagactacttaatgcttaacgttgataattgacatcaaagagtgggccaggaactgtgttagcaattatgtttttttcatttaattctcatatcaacctgatgagatagacagtattttgattcaaatccagatcctgtgctctttctgctgttcaaggtagcttttaagccatgcactcttgagttctaaatattagacttaaaaatgaaacttgggtcaggcatggtgactcatgcctgaagccaaggtgggtggatcacttgagcctaggagtttgaaaccagcctgggcaacatagcaagaccttgtctctacaaaaaaattaaggaaaaaaaataaaaacccaagaaatgtgatcacatgcatattcataaattggatactctcaacatcaatagagaggttgttaaacatagattgcagaaccaggctgcctggattccagtcattcactcactgatgaccttgagccaatgactttacctctttgtatctcatttcattaactgtctaataataattggtcaggtgcagtggctctcgcctgttatcccaacactataggagactgaggtggaagaaagcttcaacctcaagagtctgataccagcctgggcaacatagcgaggcctcgtctctaattaaaaatatatatatatatagccagcatggtggtgcatgtagtcccggctacttgagaggctgaggtgggaggatcacttgagcctggaggttgaggcttcagtgagctatgattgtgccactgtactccagcctgggtgatagagccagaccctgtgtcaaaaaaaaaaaaaggccgggcatggtggctcatgcctgtaatcccagcacttggggaggccaatttgtgtggttgggaggttgtgaccagcctggccaacatggtgaaacctcatctctgctaaaaatacaaaaatttagccgggcatacacctgtaattctagctgctcgggaggctgaggcaggagaatcgcttgaacccaggaggcagaggttgtggtgagccgagatcacaccactgcactccagcctgggcaacagagcgagactccatctcaaaaaaaaaaaaaaaaaattctcccttcacagggttgttatgaagattaaattcctatgtattacatgccaagaacagtatcttgcacataacacgatgagaaaccaaggcgatgtgactgtacaggttgaatatcctttatttgcaatttttgggaatagaaggattgcagatttttttaagattttggaatatttgcattatacgaattgaaaatcccttgtctgaaaatctgaaatacaaagtgctccaatgagcatttcctttgagcatcatgttggcactgcaagtttcatattttggagtattttggagtttgaattttttggatcaggaatgtcagcctatattagagattgtgctattgtgcatgtgaaagtttgaaatctgcattatgaaataactttcagataatactttattccattttaatgttagtaacccaaagaggattccaactcagttaatgtcatttataatttttgtttattaggaaaacaaattgtaattagaatatttagtgtaactatatctgaagtgttcttagttttaattttcatattttaatttaaatattgtcacttggatgtatattattcaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagtaagaaatttttacacttttaaaatctgttggatatcacatagtcttaaaatggaaataaaatgtcacttttaaaaaaatgtcatgtattttggttctgctctaagagttagagctaggtcagatactgtttgcctaggcctaagacatagtaggaaatcagaatattttctgaccgtaagcaggattaaaagtaaaaacatgcaattgcaggccatatccatgtgtgtaaatctttaaaattatagtttgctgaaggtaagagagcagatcatctagacttgtagtggcaagtgttggtagcctaaagccctcttaacactgggctccagccaacagagccttatacaaattaccaggtagtttaaggtttctttcaatcgtcttgtatttctctaatttacaagcgttctgtctccccaaccagagatgtttatcgccttttctgtcttttttgatgactgctccccctcagttctttcactccctattgcccattttagtgtcccaaataatccctccttttgatagcaaatgcctgttttcagtctgatgaccctaaaggaaagaaattaggatttctaaatggaaaccttcataccatctgaggaaaatgggcatcacttaggtggcagtgaggacactcctctgtcactggatcctcttactttgaacctgagtgactattcccacctgattcttttctttctctcctttcttttcctccccaacatacgtttatcgtctcttgcattagtgaatggaattcgtattctttcatgtagagagcaacatcttcctacatagtaaataaaagagtaaagaccactgtattgagatgagaaatcaagggaagaaagcaacccaaagctgaaaaaggtgaaatgggagtgcattaggaaatggaatattttaagtctagagaagccataatctaagcatcagaattgttaatttagttcttgctaatgtggaaaaaataggtgcttgcttccagttgttttttatttatttattattttttaacagtttgttactatgttggtattgtatgtctaaaattttcaaactcttcaaatgagaggtgctatataattataaagaaggtattatctttaataattccagaaattttttataggagcatctttaacagaattagactcacctcggttgccctctcatttatcagaatatgaacgggatacattacttgttgaacctgaggtaagttctttgatgacacttagtataggttacaaaggatatattattcgtgtgcatatatatttgaccattgcatttttaccaaatttatgtatatatgcttctttttataggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatgtaagaccatttgacttaaaatgtttatgtttatagtatttccttagaattaagaaaagaaagtttacttttatccctaattgcctgacattattttatgtgacttttcttcataactatgctaaagttaatgtaaccaactcagtgtttataatgaagcttcagtagcaaatctgatttttctgctgataatatagcaccaattgtttctaaagttattttctttttttcttttttttctgtgtgtgtgtgtagagacagggtcttactgtgttgctcaggctggtctcaaactcctgggctcagacagtcctctcacctgagcctccgaaagtgctgggattacaagcgtgagccaccacactcctgtctctaaattttctgattttgtgttttgtgttatggtggtttttttttttttttttttttttgagaagaggctctatctacagctatgttacccagtctggtcttgaactactgggtttagggaatcctgtcctctctgccttcgaagtagctagaaatacaggcacacaccaccatgcccagcttatttttttttttttttcgagacagcgtcttacttttttgcccacgctggagtccagtggtacaaacatggttcactgcaaccttgaccttctgggctcaagcgatcctccaacctcaggcactccccatctagtagctgggactacaggcaagcaccactatccttagctaatttttttttctttgttttagagacagggttcaccatgttacccatgctggtctccaactcctgagctcaagcgatctgcctgccctggcctctcaaaagtgctgggattacaggagtgagccaccatgcccagccccagcttattttctgattttaaaattaatacatactcaaaatatgacaaccattaagaagtagatacaagagaaagaactgtacatgttgctacactttctgctagtttttaaaatttatttcttttacatatttgaaactatttaccataaaatttgtattttgttcttaacatcttaacactgcccttaccagtacaacagccaccaaccacatgtagctatttacatttaaatttaaaaattcagttcctcagtcatactagccacatctccagtacttgataactgcatgtggctgatggctactttattgaacagcccagatacaaaacatttccatcattgcagggcgttctgttggacgacactattttgatacgttaatatttctgtgtgctataaatattaaaataaggccgggctcagtgggtcacacctgtaaacccagcacttaaggaggccgaggcaggtggatcacttgagctcatgagtatgagaccagctggggcaatgtgatgaaaccccatctctacaaaaaaataccaagaaaattgtttgggtgtagtggtcccagctactcaggaggctgaggtgggaggatggcttgagcctgggaggcagaggttgcagtgagctgagatcacaccactgcactccagcctgggcaatagagctggaccttgtctcaaaaaattaaaaaattgaaatagcagtaataagtaaaattaggaaagacacagaaaaaccatttatgttatagagcttcattactcagcagttgaatttgcttaacttttaaaataattgtttctttcttattttgaaattttccatcctataaataaattaaaaggatagtacaatgagccaggagtggtggttcctgccagtaattctgcactttgggagtccaaggcaggaagatcacttgaggccagaagtttgagaacagcctgggaaacacagcgagaccccatctctagaagagattttaaaaattagctgggtatggtggcatgcacctgtagtcgtagctacttgggaggctgtggtgggagaatcacttgagcccaggagtttgaggtggtagtgagctgtgatcgtgccaccacattccaggctgggcaacagactgagaccctattttaaataataatacaaaataacgaaaagagtataattgacttgtttgtgacaccaaggataaatgcttgaggtaatggataccccatttaacttgaggtaattattacacattgtatgctggtatcaaaatgacccctgtacctcataaatatatacagctactaagtacccacacaaattaaaaattaaaaaaaaatgatagtacaatgaatagctgcatatccttaacttttgtttagcagtttgcatattttgccactttttcttaatctctctatatatttacgtatttgtttctggctgaataattggaaagtattagtaattgcgaacatcgtgacacttaagcagcataaggacattgttctattacaactaccatagcattatcataccccattgaaactaaaatataactagttgatataactggcctctcaaagtgctgggattacaggcgtgagccactgcgcccagctgcatagtcatattttagtttcaattatattttagttatattaactaattagttacattaactaattagttatataattaagttaactttccagagaaacttcacactaatctagcaatatattgtccctattcagatttcctcatttgcctcaaaaatgtattcaaagttgtttcctccacccctgtccaagatccagtcagggtttacacatttaatttgatggctatgtcccagtggaatttgctttagataagtttatagtgctgttatttatagggctgtagtgatgttgaagaaagtgaacacatagaaactaaatacggttagtatttttgtatatatcaggaataccagtaatgctcttttataaatctattttctttcacatcttgtctcatttgttagacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaaggtaaaaaaaaaaaaaaaaattctgtactttcaatatgtgaactttatggtacgtgaattataactcaaagcagttattttctttaaaacataacaaaggaaaaaatatttcatttttaataaaatagttgctaaggtccacaattagattctgagtttttataaaacataaaaaggtgactcttaaatgcttgtacaattttttaagggaaaaaagaccatcacaatttgaaaatattagttcagttttattggaatcaaagcgtagttacattttattttattttttatttttttattttttgagacggagtttcgctctttttgcccaggctggaatgcaatggcatgatctcggctcactgcaacctccgcctcccgggttcaagcagttctcctgcctcagcctcccaggtagctgggattacaggcgccagccaccacgcctggctaattttttgtatttttagtagagacagggtttcaccatgttggccaggttggtctcgatctttggacctcatgatcctcttgccttggcctctcaaagtgctgggattacaaatgtgagacaccatgctcggccatattttattttttattttttatttttattcagacagagtcgttctcttgcctaggctggagtgcagtggtgccatctctgctcactgcaacctctacctcctaggttcaagcaattctcccacctcagcctcctgagtagctgggattacaggcatctacctccatgcccagctaatttttgtatttttagtagagatggggttttgccatgttggccaggctgttcttgaactcctgaccttaagtgatctgcccgccttggcctctcaaagtgctgggattacaggcatgagccactgtgcccagctgcatagttatatttcagtttcaattaaaaacaaactttagggccaggcatggtggctcacacctgtaatcccagcactgtggaaggccaaaacaagaggatcacttgagcccaggagtttgagaccagcctggtcaacatagtgagatcccatatctacaagaaaaagaaaaaaattgtaaataaataaaccctagttcaacctgagaatgctgattggaaaatagaaatccctagtatataaaatttcagttaggcaggaggaataagttttttttgtttttggtttttgagacggagcctcgctggccaggaggaataagttttaagttcaagagatatgttgtataacatggtgactattaacaacaatgtgtcatgtatttgaaaatcatggccgggcatggtggctcacgcctgtaatcccagcactttgggaggctgaggcgggcagatcacgaggtcaggagatggagaccatcctggctaacacgatgaaaccctgtctgtactaaaaataaaaaaacttagccgggtgtggcggcgtgcgcctgtagtcccaactactctggaggctgaggcaggagaatggcgtgaacccaggaggcggagcttgcagtgagctgacatggcgccactgcactccagcctgagagacagagcgagactccatctaaaaaaaaaaaaagaaaatcactaaaacggtagattttaagtgttctcaccacacacaaaaaatatatgtatgtaaggtaatgcatatgttaattggctcaatttagccattctaccatatatacatatttcagaacatcatgttgtatacctataaatacatacagagcttatttgtcaatttaaattaatcaaagaaaggagaagaaatcttggccttgcctctatatggacaaggtattcacctaatgtgttcttactctccacagctaaaaatgtagatgattgaattatttagaggtaaaaaatgggaggcacacaagttgaaaacaaaatacacaacagttttcaaaatgaattgccaatctttaaaaatcagactaatgattaaaagtcagatatgaatttcggctgggcgctgtgactcacacctgtaatcccagcacttttgggaggctgaggcgggcagaacacaaggtcaggagttcgagaccagcctgactaacatggtgaaaccccatcgctactaaaaatacaaaagtttgccaggtgtggtggtgcgctcctgtaatcccagctactcaggaggccgaagcaggagaatcgcgtgaacccgggaggcagaagttgcagtgagccgagatcatgccactgcactccagcctaggcgacagaaaaagactctgtctcagaaagaaaaaaaaaaagttagatatgaatttctagcttcagaatttctggaatctcctggttaaaaaaaaaaaaaaaaaaaagaggccaggtgcagtggctcacacctgtaatccgagcactttggaaagctgaggtggaaggatcactagagcccaggagtttgagacctgcctgggcaatatggtgaaaccccatctgtataaaaaaaaaaataataaaaaaattagctgggtgtggtggcaaacaccaggaatttgagaccagcaatatagtgagatcccatatctacaggaaaaaggaaaaattttttttgtttttcctacctagtcccagctacttgggaggctgaattgggaggattgcataagcctgggaggcagagtttgcagtgaacaatgattgtgccactgcactccagcctgggcaacagagtgagacccccatctctcaaaaaaatgaaagtgaagtataacactggctcatatttctgcgtagcaacaatcacctcgccatgtagcatctgcccctttgagatgagagtagtaggcaccactgtccccagctggttcattcacttatattgcctgcttgacttctgtaatatctgaattcgtgacccctggactgggtcgtctctgagatgtcttccagttctaaaatcatacagctgaaaattaccctataatttattacctaggacattttttccaacagatttcttggagaatttaatgacttttaagcaatttatatctcattgacttgctttgtcttttatagcatatatattaattttgcattgttgctgcatataaattatctaagactgttagcttcttgaaggcagggattgtgcttttctcttgctcagcataacgtgttgactaaagaaaacaaattatttcattgaaaactattttcgtgtaatttatgatgtgtgtgtgctcataaacaattcctttgagttttaaatttggttttcttatacattcaatgtcttttaaaaattgttgtttattaaatgtggaatagttgtgtaggtaaaatactttattaaacgatgctaaaaaaactataaaggactacttaaataagctattaaaagtatatttgtgatatataaacccacaagttaatataaacttattgtgtaagtttatataataaacttagtttgtctaggaatacatatttttaatttcatttttcctttcatcttttttttttcttttctatacagtatcgggaaaattgcctggcagcaaaagcactttttcctgacttctgcctaccagctttatgcctccaaactcagctattgccataccttgctctactaaccattccaatgagaaatcaaggtaataacataggtttttcttttcttttaagaagtagggtttatttatttatttatttattttatttttttagggggagtctctactgtccaggctggattgcggtggcacgatctcggctcactgcaacctctgcctcctgggttcaagcaattctgttccctcagccttctgagtagctgggaccacaggcacgcgcccccacacctggctaatttttgtatttttagtagagatggggtttcactgtattagccaggatggtctcgatctcctgaccttgtgatctgcctgcctcggccccccagagtgctgggattacaggtgtgagccaccgcacacggccagaagtagggttttatagcaatatctttttgtgggccaatttattgctatatgcagtgagatactttttttccttttattttttgatccagataattctggatcctttatgttttttttttaaaacgcatcaaacaggccaggtgcagtggctcatgcctgtaatctcagcactttggaaggtcaagacagggagatcactggaggttaggagttcgagaccagcctggccaacatggtgaaaccctgtctctactaaaaataaaaaaattagccaggtgtggtggcatgcgcttgtaatcccagctactcgggaggctgaggcaggagaatcacttgaacccaggaggtggaggctgcagtgagccaagatcgcacacctgcactccaggctgggtgacaaagtgaggtctgtctcaaaaaaacaaaaagcatcagatgatacagaaatatataaagagccgaacgtggtggcttatgcctgtaatcccagcactttgggaggccaaggctgggaaaccccatttctactaaaaatacaaaaaattagccaggcgtggtggcacgcgtctgtaatcccagccactcgggaggctgaggcaggagaaccttcaaccccggaggcggaggttgcagtgagccaagatcaggccattgcactccagcctgggcgacagagcaagactgtctcagaaaaaagaaaaaagtttctaaagtaaaaattgaaagtacttcccctacaaccacaggttgctttgacagattaatgtaaattcttccagatactcttctgtggatgtagaaacatgcagaatgaggcaagctttaatttgcttatgtcacttactgtggatagcctttcatatcttataagttaatgtcagagcagcaatctcatttttttccaatttgtaaacattttatttaaccttatgatggatattttggtggatttcagtattacaaaaatgcctattaatagtatttttcattatatttctgttacgaaattataatgctacaaacattactatgcctgtggcagtatacatctgcacaagttttgaaaatgttatgcattcataggcaaaaatgggataacttttgggcagtggtcatgattaatctgttgatcagaatccagagattgcccttctccttgccaattgctttaagagtacactagtttttggccgggtgcagtggctcatgcctgtaatcccagcactttgggaggccaagacgggcggatcacaaggtcaggagatcgagaccatcctggctaacatggtgaaaccccatctctactaaaaatacaaaaaaaacccacaaaaaacaaaaaaaccaggcctggtggtgggtgcctgtagtcccagctacttgggaggctgaggcgggagaatggcatgaacctgggaggcggagcttgcagtgagccgagattgcaccactgccctccagcctgggcaacagagcaagactctgtctcaaaaaaaaaaaaaaaaaaaaaaaagattacactagtttttaaactttttgtttttttttttgagatggagtttcactcttgttgctgaggctggagtgcaatggcatgatctcgacttactgcaacctctgcctcccaggttcaagcgattctcctgcctcagcctccaaagtagctgggattacaggcatgtgccacaacacccggctaattttttttgtatttttagtagaggtggggtgtcaccatgttggccaggctgatctcgaactcctggccttaagtgatctgcccacctcggactcccaaagtgcggaattacaggcgtgagccaccgcgcccggccactggtttttaaactttattttgaaattatttcaggctgggcgcagtggttcacgcctgtaatcccaacactttgggaggccgaggcgggcggatcacgaggtcaggagatcaagaccatcctggctaaccccgtctctactaaaaatataaaaaatcagccgggcacggtggcaggtgcctgtagtcccagctactcagtgggctgaggcaggagaatggtatgaacccgggaggcggagcttgcagtgagctgagatcacgccactgcactccagcctgggagacagagtgagactctgtctcaaaaaaaaaaaaaaattattttaaatgtaaggatgcaagaatagtacaaaaaattcttgtatatccttcactaagtttcctgattattacattttttaccatatttgcctgattatattctctctctttataagcatgcacatatatgtattattttgctaaactagtcttgagtaaattgcaggcatgatatcccattattcttaaaaacttaagtctgcacttgccaaaaacaaggacattttcctgcataaccacagtgtgcaatcaaatcaggaaattaacttaataccgtttattttatagtccccattcaaatttttccaattgtcctaataatatccttttttaattatttttaattaatagagatgggatctcgctttgttggccaggttggtcttgaactgctggcctcaagcaatcctcttgcctcagcctcccaaagggctaggattataggcacaggccactgcacccagccctaataatctcctttgtaaaatgataactccccatttcttgtccagaatccaatgaaagataacctgatgcatttagtgatttagtttccgtgtgtttttagtctcccttgatctggaacagttttgtagtctttctttgtccatgacattttagagggatataggacagttactgtacgatccctcaatttgggtttgtctggtgattcctcattattggattcaggatatgtatttttttggcagaaataccacagaagtgatcttaaaaaaaattggcaaggagaggaaagatatctggattctgaccaacagattcatcatgtccactgcataaacgttatttttgcctatgaatacacaacattttaaacactttaagtatcagtacttacaaaagctgtaagataaaacacttcattgtatcaaagtagatatttagtctttaatcctttcttctgatcactgataaggtcaactctatctttaaaatttctgggccaggcatggcggctcatgcctataatcccagaactttgggcggccaaggtgggaagatcgcttgagcccaggagtttgagaccagcctaggcaacacggtgataccttgtctctacaaaaaaatttaaaaattagctgggtgttgtggcttgcacctgtagtcccagctactcgggaggctgaagtaaggggatcacttgagcccgggaagtgaagggtgtagtgagctgtgatcaccccactgcactctagcctgtctagcttgggtgacagggtgaggatgagaccctctccaaaaaaataaaataaaatttctgagatgttttgataagttatatggtagattactaacatttttaatatgacacaaattctgttttctgttttgaagattagcaccacagacaggtgatcattaatgaaatatggcccttaaaatacacattacaaaagagaaactgatggtaaaattgctggtgaagttaacttttatcatttctccactaattaaaagttcagattctgggatcacatctctaagctgttcatatcaaagagctattttttaaagatcctgattataggcaacaaaagcaaaaataaacaaataggattacatcaaaactgaaaagcctctgcacagcaaaggaaacaacagaatgaagagccaacctacataatgggagaaaatatttgtaaattatacatctgataaggggttaataatcaaaatatataaggaactcaaagaatgcaatagtaagaaaacaacccaattaaaaaacaggcaattccagcctgggcaacatggtgaaaccctgtctctacaaaaaatagataaaattggccgggcacggtggctcacgcctgtaaccccagcactttggttggccgaggtgggtggatcgcctgaggtcaggagatcgagaccagcctggccaacatggcaaaaccccacctgtactgaaaatacaaaaaattagctgggtgcagtggtgggcgcctgtaatcccagctactcgggaggctaaggcaggagaattgcttgaacccgggaggcggaggttgccatgagccgagtttgcaccattgcactccagcctgggcaacaagagcaaaattctgtttcaaaaaaaaaaaaaatagataaaattagccgggtgtagtggcacacacctgtagtcccagctacttggaggctgagtgggaggatggtttgagcctgggaagggaaggttgcagtgagccgagatcacgctgctacattctagcctgggggacagagtgagatgctgtctcaaaaggcaaaggaccagatagacatttcttaaaagaagactggccaaaaggtatatgaaaaactgcttaacattaaggcttaacactaatgatcagggaaacacacttaaaaccacaatgagatatcatattacaccagttagaatggccgttaccaaaagataaatgataacaaacgttggctagggtgtggagaaaagggaatcacagagttagtaagaatgtaaattagtacagctgttttgaggaacagtatggaggttccttaaaaaactgaaaataggccgggcgcagtggctcacgcctgtaatcccagcactctgggaggctgaggcgggcggatcacgaggtcatgagtttgagagcagcctggcaacatagtgaaaacccatctctactaaaaacacacacacaaaaaaaaaaaacaccaaaaaaactaaaaataggccaggcgtggtggctcacgcttgtaatcccagcactttgggaggccgaggtgggtggatcacctgaggtcgggagttcgagactagcctgaccaacatgatgaaactctgcctctactaaaaatacaaaaattagctgggcgtggtggcacatgcctgtaatcccagctacttgggaggccgaggcaggagaattgcttgaacttgggaggcagaggttgcagtgagccacgatcacgccattgcaccccagcctggcaacaagagcaaaactctgtctcaaaaaacaaacaaaaaaaaaactctaaaaatagaactaccatatgatccagcagtcccactactggacatatatccaaagaatatgaagtcaaggccaggtgcagtggctcatgcctgtaatcccagcactttgggaggcgaggcaggcggatcacttgaggccaggagtttgagaccagcctggcaaacatggtgaaaccccgtctctaccaaaaatataaaaaattagccagatgtggtggtgtactcctgtaatcccagctaccgtggagtctgaggcaggagaattgcttgaatccaggaggtagaggttactgtgagctgagattgtgttgctgcactccagcctaggtgacagagccagactccatctcaaaaaaaaaaaaaaaagaatatgaagtcagtatgttgaagagatatctgccctccctcccagttttattgcagcattattcacaataaccaagatatagcgtcagtctaattgtccattggatgaggaaaacatggtatatatacacagtggaatactattcagccataaaaaagaacaaaatcttgtcatttgcagtaacatggatgaacctggaagaccttatttgaaatgaaataagccaggcacagaaagacaaatattgcatattctcacttatataggagctaaaaaagttgatctcataatagtagagcacagaatgggattaccatgggcttgggtggtaggggagttgttgatcaaagaatacaaaattttgttatgtaggaggaataaattcaagaattctattttacaacatggtgactataattaatagtattttgtgtgtgtgtgtggttttgtttctttttttgagtcagagtatcactcttgtcacccaagctggattgtggtggtatgatcacggctcactgcagcctaaacctccttggcccaagtgatcctcctacctcagcctactgagtagctggtaaccacaggtgcgcaccaccacacttggctaatttttgtattttttttttgtaaggatggggttttgccatgttgcacaggctggtcttgaactcctgggttcaagcaatcctcccacctcagcctcccaaagtgctgggactacaggtgtgagctaccacaccgaaccaatatattgtattcttgaaaaatgctgagagtgaatgtaaagtgtctttgccacaaaaataataactctgtgaggtaatatatatgttaattagctatagtcattctactatatatatattaaaacaatatgttgcccacagtaaatatatacaattttgtttgttaattaaaataactctgtttgtagtagatttttttttttttttttttttgagatggagtcttgctgtatctcccaggctgcagtgcagtggcaccatcttggctcactgcaacctccaattcccaggttcaagcgattctcctacctcagcctcctgagtagcttgaattacaggcgcataccaccacacccagctaatttttgtatttttagtaaagatggggttttactatgttggccagtctggtctcaaactcctaacctcaggtgatccgcctgcttcggcctgtgtagtagaatttttaacaggttaagtatccaaaggtcctcatagtgttagatgtgcaaactttaaaaggttcataaaaattagtaaaagtaagatgttttggtttttcttatcaatttttatactgtttcttccgcttttatttactatgtcattttcagccattatttctttaaatatttttctgctgctttctgtccttctagtctttcattagggtatgttcacttgaaagtgttccacatttttctgagattttgtttatatttcttctgtcttctatatgtcaatctatgtccaagtttttttttttttttttttttttttttttttggagacagagtcgccctctgttgtccaggctggagtgcggtagcaccatctcagctcactgcaatctccacctcctgagttcaagcaattctcctgcctcaaccccctgagtagctgggaatacaggcatgtgccgctatgcccggcggggtttcgccatgttggccaggctggccttgaactcctgacctcaggtgatctgcctgcctcggcctcccaaagtgctgggattacaagcatgagctaccacgcctggcctatgtccaagtttgatgatacttctggttcaaatctactgttgagcccctttagtgaatttttcattttagttattgtaccttttgactgcagaattttcatttggttctttttataatttttgtctttttgttgatgctctttttcatgagacattgtcattacagctttgtttactactttgagcatgatttccttttctactttgaaaatatttataatggtttatctgaagtctttttctgttaaatttaatgtgtgagccctcgcaaaggcagtttcttttacccacctttttcttgtgtgtaggtcacactttcctgtttctttacagtcataattttttgttgaaaactagatgttttagggaatatattgtagcaattttggagaatattgattctcctcctctggggcttgtttttattgttgtgtgcttgtttatttgtttagtgacttggctaaactcatgtaatgaagtctgtcttttgcaacatgaagccttcctccctcttcagagagctcatccttggctgtgcccacagtttacttgggatgatggtggttttagcagagctcactttgtctctttccctgatatgtctgtatagctctttgcttcctttgttatcacactgttggctaccctaattacttttttttttttttttttttttttgaggaaagagtctcgctctgtcacccagactggagtgcagtggtacgatggctgactgcaacctccgcctcctgggctcaagcaattcttatgcttcagcctcctgagtagctgggactacaggcatgtgccaccatccccagctaatttttctatttttagtagagatggcgtttcaccatgttagccaggttggtcttgaactcctgacctcaagtgatccacccaccttggcctcccaaagtgctgggattacagacgtgagccactgtgcctgactactccctaattactatctaattgctctgttttcagcagtgctctaggacaaaaatttctccacaggctgatccagtttaatttgggcaggtgtaggctttcaagccagtttctgagggttgttctgaaaccaggagggcccttcttagttgtctctttccctggtttcttatgaactagttggcttatgtttagcttgttcttatttaagaggagctggtttccagggtgccctttaggcttgaacttccccacactatgtttcaaataaagtgagttcctttggggaaggcttcggagctttttcctacggactgcctctcctctgggcaaaatctctaagccacttattctgggtgggtgcccagctgcagaggtagcctctgattattttggcttgcctctcccagtgtggaccctctgctatgtaacaagctggggtaagggagactgcagctgggacaggggacagtgcctttgggttagaacctcttatcctatgagtagggccaggtggggaaaggaagccccaaacaccctgctgcactccagtaggaaggagtcctttgttcttggctgtacccacctggaatgaaatgttcatcaagctgagccctctcagctcagggttgggaatgggagggaggagatagtggctcagatgcctcagattcttcctgtttggttttcttgaatagatcttttctcatttgctgtatgctattaggacaatttccagagacttcaaatgattgatttttaaaagttttcaccgattttgcttatctttgggagtgggtacacaagagcttatgctgtcatcctgaaagtttactatgtcattctttttctttttgcatttttaattgtgataaagtatacaaagcataaagtttatcatcttaaccattttgaattctacagtgcagtagtgttaagtatatccaccttgttctgcaaccagtttccgaaacttttgcttcttgcaaaactgaaattctataactattagcattaattccccattttcccttccccctggcagccaccattctactttctgtctctatgaatttatgactctaaatacttcatataggtggaatcatacaatatttgttcttttgtgactagttgcacttagaatgatgtcatcgcagttcatttgtgttggagcatgtgtcctttttaaagctgagtaatattccatgagatgtatataccatatttggttatccattcatctgttgatggacacttgggttgcttccacccattgattattgttgatgctgatatgaacatgggcatacaaatatctttttgagactctgtttttaattattttgggtatatacccagaagtggaattgttagatcatacaataattccatttttaattttttgaggatgcactatactgttttccacagcagctacaccattttacattcccatgagcaatgcacaagggttccagcttctccacatccttacccacacttcttgttttctggttttttgtaacagtcatcctaatagatgtgaattggtatctcactatggcttggatttgcatttctctaaagattagtgatgttcagcatcttttcaggtgcttattggccatttgtatattttctttggaaaattgtttacaacttttaaaaaatctgtttcagctcagatttcttttatccaagatattggaaggctccctctgaagcgacactttggaaggtaagctgatcatctcaatttccaaaaagctgataatgaaatgtctactgaatatgttcagtatgaatcaataactgttacctgtaacatccaagaaagacatactgtacctagtaatttataaacataattgtattgtagacccttccttttcttaaatataacagcatatcttcacccactcccaatggactataccagattaaatggaagcatggaatcacaaaggcagaggaatctttaaaatcctccaactcaacaaatctagaaaccccttgccagctttcctgttgagagatgttcttagcctatgcttgaagacctgcagtgactaggaactgcctcagaaagtagaagagtccttcatattttcttattttagaaaatttaaacaagcaaaaaatagatgtctgtctatatatatatatatatatatatatatatatactgttcattttattggaaagtagcttctgtgccattatcagtgattaacacaaaacttatatttcagtttgacttagcttatttgtaagatcgaattaagcacttaggaattgtttaaagattttaaaaatggccgggcgtggtggcttatgcttgtaatcccagcactttgggagcccgaggcaggtggatcacctgagataaggagttcaagaccagcctggacaacatggtgaaaccgtgtctctactaaaaatacaaaatttagctgggtgtggtggcacatgcctgtaatcccagctactcaggaggctgaggcaggagaatcgcttcaacccaggaggtggaggttgcagtgagccaagatcacaccattgcaccccagcctgggcaacaaaagcaaaactccatctcaaaaaaaagatttaaaaaaatcttgcttactgaatgcatggacaaaagtaagtgatagaaatggcacctctgactcctcctaccttttctcctatttctggtcccaaatggaaaactcctgtgatgtgagctttttccccctctttaccctccaagattcattaaggcctttgtagtgttaatgtttttttctgtatactggcttagctatgtggggcccatctttcctatcgcagaaagaccatgatggatggatcttgaagcatcgtcccactgggatgtgatcagggcttacacatttcataaacactgcttttcttctcacatccctctgaatgaaagcaggaccaagtctctttgatggcttctctccccaaccccctaagattatggcatcaaaataaagacaagtatgttctattgtatttttgctcctgagatgtattgagttgctgcaatttacacaaggctaaattgaatgagaatcttcactattttattattggttcaactacctacttgatgtgacttgagaggcagtattttcttttcttttttttttgtagacggagtctagctttatcgcccaggctggagtgcagtagcacgatctcggctcactgcaagctccaccttctgggctcacaccattctcctgcctcagcctgccgagtagctgggactacaggcgcccgccaccacgcccagctaattttttgtatttttagtagagacagggtttcactgtgttagccaggatggtcttgatctcctgacctcgtgatccgcccacttcggcctcccaaagtgctgggattacaggcgtgagccaccacgcctggccacgagaggcagtattttcagtgctatatattacaatgactggtactatcttttatttatgttgaccatatttaaaaccattgttcatatgtttagtatttagtattaaatattaatacttaatatttaataggtgtttaatttcctgtaattcaacctacacgttatttttgcccatttagctttttttcagcttttactatcccagccttatagataagtcatcatgcacttcaaatactatttacttagggtgaattcctacaaatgaaattgctggatcaataggtatataccttttggggcttttcctctttattgccaaattgttggcaagaatattttgccagttttgtatccacttacagtgtatcagtatgttcttttctcctaacccttgccaccactgggttttaaaagtatctttgccagtttagaagatgacagtaataggccaggcgcagtggctcatgcttgtaatcccagcactttgggaggctgaggtgggtggatcatctaaggtcaggagttcgagaccagcctggccaacatggtgaaaccctatctctgctaaaaatacaaaaactagctgggtgtggtggtgcccgcgtgtaatccctgctactccagaggctgagacaggagaatcgcttgaacctgaagtggaggttgcagtgagccaagatcgtgctactgccctgtagcctgggtgacagagcaagactgtctcaaaaaaaaaaaaagatgacagtagtagctcattatgttaattttcatttttaaaattacaaattagatttaacaatttaggaaccatttgtatttgttttataagttgtccatgtttgtgcccatttttctatttcattttttcctttttaatttgtaaaaattctttactgaaggctgggtgtggtggctcacacttgtaatccccgcactttgggaggcggaggcagatggatcacctgagttcgggagttcaagattaccctggccaacatggtgaaaccccatctctactaaaaatacaaattagttgggcatgatggcatgtgcctgtaatcccagctacttgggaggctgaggcaggagaatcgcttgaacctgggaggcagaggttgcagtaaactgagattgcaccactgcactcctgcctgggcgatagagaaagacagtctcaatgaaaaaaaagaaaaaagaaaaattctttactgaagacattatttctttttatttttaggtgtttttgttgttgtggtttggtttggtttttttgtttgtttgttttttgtttggagacagagtcttgctctgtcgtacaggctggagttcagtggcacgagcttggctcactgcagcttctgcctcctgggttcaaacaattctcctgcctcagcctcctgagtagctgggattacagatgcgtgccaccacgcctggctaatttttctattttcaatagagatgggtttttgccatgttggccaggctggtcttgaactcctggcctcaagtgatctgcctgccttggcctcccacagtgcagatagtacaggcatgagccatcgtgttcagctcctttttgtattttaagttgtaggaacttattcagtttgtcatttaccttgtagttttgtttttatagttaaagggactagctaaacagcacaatgtaggtaaatgaaagatggcttcataatcatcacactcatggtgtaatttaaaaatcttctcctttggttcttattaatgcctgcactgtgaatctgacagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 193 - DNA, 51350 bp, Homo Sapiens
actcctggcctcaagccattctcctgcctcgccttcccaaagtgctggaattacaggcaggagccactgcgcccggccagtgctggagaatgtaatggagatgatcctgcctatccctgagttccagtctagtttactgtcagagaatacttatttccatttttcctattttgttcttgagtctctttcctcagaatttacttttccacttaaatgacgtacgcagcttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaattgcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaagataacagttcaaattttgatggaaaaatcaacctatgcttgtgtgtgtgtgtgtgtgtgtgtgtgtgtgtaatgtgtacagtgtgtgtggttgttgagataagcataattatataaaaatatgtgtgtgtgtgtttaatgtgtacagtgtgtgtggttgttgagataagcataattatataaaaatacataaaatatgtacacttcaatgtgcagttgtaaagttaacattcacttaaccacaactcaattgtagaaagatcatttacagacccttaagaacttcctatatgcagtctcccaatcacaacccacttctttcccccagaaataatcacaaaatagactttggtgataatcttttccttcgtgtgttttagagtgttctcagctatttatgcaaataatatcatttagtttatgtatttttaattaatatggtttttattaacgaactttatatacattttgctgtatttttcatgtgttgattttttatagccatgcttttgtgcatattgaattcattaattttaatttttatataggatgtatttatgaacatcccactaactattctgctgctaattgatatttggattgtgtacagttcgatgctattataaaattcttctaaggacattcttgtacatgttcatttgttttgctaggtcctagagtctaaggtatatatccagaagaggaatagctggatattaggatagaataatgacaaactgttttctaaagtgattgtacagattagtgtttccataggagaaaagtgtacagttactggaaaaacagtttggaatgatctaaagcataagaatgttcatagcaacagaatgtatttctagtattccaaattttcacctacagttggtgtggtcagtataagttgttgtttttgtttttgttaatgtttttttttcctttgagacagggcctcactttgctgcccaggctggagagcagtggtacaaacatgactcactgcagccttagccttgcaggctcaagcaatcctcctgcctcagcctcccaagtaactgggaccacaggcacatgccaccacacctggctaacttttgtattttttgtagagacagggtctcaccatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctatttagacctttcctctgtctattgttttatattttgtattaaaggagtcattcattactccaagatcatgaagattttcttgtatgtaatcatgtaatcttcttaaaagcttcatggcttttgcttttttttttttttttttttttttttaagagtcttgttgtgtctccaaagctggagtgcagtggcacaatcacagctcactgcagcctcagcctccctggcccaagtgatccttccacctcagccttctgagctgggactatagccatgcaccaccatgcccagcaaattttttattttttgaagagaccagatttcactgtgttgccgaggctggtttcgaatgcctgggctcaagtgatcatcctgccttggcctcccagagtgctgggattacaggtgtgagccaccatgtctgcctggcctgttttttggctgatttaggtctataattcatctgaaattggcttttgtgtagaatgtgaggtagagattaggtttcatttttttccttcatatggctatccagtttagcactggttattgaaaagatcattattttttttcactagtcttcattgatatccaatcaagtactcaaatgttttaattattttttatactttgtattgaatcagatccaaataaagtttaaacataataatcgattgatgtcttttaagttgcttttagtctgtaagttccctctttattcccttttttttctcttgcagtttattggttgaagaatccagctggtttactctatgattttcttaagtctagatttgtgggtttgattgctatgatagtttcagatctttcttctattttctgcatatcctataaatacattcgagatactagtcctgtgtcaattatatgttgcatataggcattttataaatttcctaagtaccatttttcttcatgccacaaatttttatgtgtactatttttgttatccagctcaaatttttttctaatattgttatgacttttttctatatttttacattgtagttctcagatctttatatgatttattttttgatccataaattattttgaattatgtttctgaatttccaggcctttgggaattgtttttatttaaaaaatgtttttattgagatattcacatagcttaaaattcactttttaaagtgttgtactccctttaaagtgcacttctgtggtttttagtatgttcataaagttatgcaaccatcaccactctcaaattctaaaacaatttcatcctttcagaaagaacctccctgctcattagcagtcactccccactttttcttcctccagtctctggaaaatactaacctacattttgtctctgtggatttgcttattccagacatttcatataaatagaattggataatacatgtgtggcttctttcacttaatggtttcaagattctccatgttgtagcatgtatcaggactccttatggctgaataattttcgtgtgcgtgtgtgtgtgtattgtacattctgttcattatgtggacattttagttctttttacttcttggttattatgaataaggctgctgtgcacattcttttacagcttggtgtgtgtccacacattttcagttttcttgggtatgtacctagaagtagaattttttgatagtgatagtttttacaattgttgggtacaggcttctgtatatctccatgtaattaactgagttaatcatattcagatcttacatatctttactgcttatacagtgaattactagagaagcatgttaaaatttactatgatttggatttgtgtatttttacttgtggttctcatttttttctttttttaagagacagggtctcattatattgcctaggctacactcaagctcctaggctcaagcgatcttcctgcctcagtctcccaactagctgggactacaggtatatgccaccatgcctggctaggttctgttaattttgctttatacattttgggactatttccttaggttatatactgatacatacttgtcatatcttcttagtgaattaaaccatttatttatttagaagtaacttctttatagatataatacttttgccttaaatattctttatctgatattaatctagccccacttgctttcttttggctaatatttatatgattttcataaaggatttattaacaaaaaaaaaaaagaaaaagtttgcatggcataacttttttgagacggagtttcactcttgttgcccaggctggagtgaaatggcgcgatcttggctcactgcaacctccgcctcctgggttcaagcgattctcctgcctcagcctcccgagtagctgggattacaggcatgcgccactacgcctggctaatttttgtatttttagtagagatggggtttctccatgttggtcaggctggtctcaaactcctgacctcaggtgatcagcccaccttgtcctccccaagtgctgggattacaagcgtgagccactgcgcctggcctggcataactttttatctttttacttttacttttctaaatcatataaaatgtccctcttttaattatcttaaaaatccaatctgacagtatttgtttttcaatggaccattgattccatttgctttcactgtaattactgatatatttggatttatttctatcatcttactttggttccactggatttgcattcttttctaccattttttttttgccttaaaaaattttttttcttgcttagtattttatttttgagacagggtctcactctgtcacccaggctagagtgcagtggtaccatctcagctcactgccacctctgcctcctgggtgcaagtgattcttgtgcctcagcctccccagtagctgggattataggcgtgtgccatcatgtctggctaatttttgtatttttagtagagacagggtttcatcgtgttgtccaggctggtctcaaactcttggcctcaagttatctgcccgccttggcctcctaaagtactgacattacaggcgtgagccaccgcgcccaaccttgcttagtattttttaaaaatcactgtatttatcctcctctcctaatttggaatctatatgctttttttttttgagggttactctagctattacaatatgcatacttgttatagtctgaagtcagtctcttgtcctctttctgacaatcaaagatctttacacttttataatttatatacaattgtctattttgataatatatatgtgtttctatgtgaatatatgtacatacatatctttgaagagatagtagatttgcatgtagttgtaagagttaatactgagacatcctgtgcacctttcactcagttttccccactggtatccaataaaataatataacgaggatattggcattgataaggtcaagataggacatttccatcagcaccagaattcctcatgatacccttttatagcaacattcactttcctcccacttctggcaactattaatcttttctctgttcctgtaattttgtcattataagaatggtatcttagcctgtttaggcttctagaacaaaaacactgtaaactgtgtggcttataaacaacaaacatctatttctaacaattctggagtctgggaagtccgagttcaaggtgccagcagattcagtgtctggtgagggcctcttccccatagatgtcacctttttactgtgtccccacatagtggaaggggcaaagcagctctttagggcctcttttttaagggcactaattccattcaggaaggtcctgccccataacctaatcacttcccaaagtccccatttcccaatactatcacattgggaattgggtttcagtatattaatttgtctggaggggaatacgagcattcagactacagcggttacataaataaaatcacatagtattgtaccttttggaactggcttttttcactcaacataattctctggagattcatccaggttgttagcctgtatcaagttcattcctttttattgctatgtggtatccacggtattgtttaaccattcacctgttgaaggacatctttgttatatctactcttttgctattgtgactaaagctgctataaatatctacaggcttttgtgtgaatatagtctttatttctctgggataaatgtactggagtggcactactcaattatatggtagtcatatgtttagttttcgagaaaactgccactcatttccagaatggctgtaccattttatattctcaccaccaatatatgagtaatgcagtttcttcacatcctcatcaatgttgtcactattttttgttttagccattctgataggtatgtagtaatatctcattgtgagttgaatttgcatttccctagtgggtaatgatgttgaacatcttttcatgtactcatttgtcatctatgtatctttggtgaaatatctcttcatgtcttttgttcgtgttccaattagatttgtttacattgagtttttaaagctacttatgtagtcgagatactagtcctttgtcaaatatgtcatttgtgaaaaaaaaaaaacaaatatgtctcccattctgttgcttatcttttcatcctgttaacagagtgctttatagggcagaagtttttaatttcaatgaaatccagtttaccaattttttcttatatggatcatgtttctgttgtctatcctagaataagcctagattctgaagattttttccagtgttttttcttaaattttgacagtttaagactgaagcatttcaaattaattttcgtataggtgtgaaccttaggttgaatttcatttttttgcctctgaatcttaagttgttccaccatttgttgaaaaggctatccttcctccactgaattgctttttaaaatttaatattagagagcagtttttatttttatttgtttatttttatgtatttttccttttaagttccttgtagattctggatattagaccttcgttgaattatgtggtttgcaaatattttcttcctttccatagattgtctctttactctgttgatagtttcttttgccatgcagaagctctttagtttaattagatatcatttgttaatttttgtttttgttgcagttgcttttgatgtcttcatcataaaatcttttccagggcctatgtcaaaatggtgtttcctgggttatcttccagggtttttatagttttagttttacatttaagtctttaatccatcttgactttatttttgtttgtggtacaggaaaggagtccagtttcagtcttctgcatatgggtagtcagttatcacagcatcatttattgagtcctttttccattgcttgtttgaatccactttccatttgagtgcttttccccttgcttgtttttgtcaacttggtcgaagatcagatggttgtaggtgtgcagcattacttctgtgctctctattctgttccacaagtctatgtgtctgcttttgtacttagtgctatgctgttttggttactgtagccttgcagtatagtttgaagtgaggtagtatgatgcctccaggataatagccattttaacaggagagatatctcaatgtggtatctcaatgtggtaatatgcatttccctgctgattagccatgttgaactattttttttttttttttttggagacagagtctcactctgtcgcccaggctagagtacaatggtgcgatctcagctcactgcaacctccacctcctgggttcaagcaattctcctacctcagcctcccaagtagctgggattacaggcacccgccactacgcctggctaattttttgtatttttagtagagacagggttttaccacgttgaccaggctggtctcgaactcctgacctcaagtgatccacccatctcagcctccccaagtactgggattacaggtgtgagccaccatgcctggccgaacattttttcatatacctattggccatttgtatgtcttttgagaaatgtctgttcagttcttttgcccattttaaaatcagatttcttttgttttatttgctattgagctgtctgagtttcatatgaattctggttattaatcccttgtcagatggatactttgcaaatattttctcccattctgtaggttgtctcttcattccgatttttttttgctgtgcagaaatgttttaacttgatgtaatactatgtctgtttttgcttttgtttcctgtacttgtgatgtcttccacagaaaaacctttgcccagacccgtgtgtcctcttagtgttttccaaatgttttcttctagtagttttatagttgcaggtcctacatttagaactttaattcattttcagttgatttttgtgtgtgtgtatggtgaaagatacggctctagtttcattcttttgcctatggatatccagtttttctagaatcatttattgaagagactgtccccagtgtaggttcttggcatctttgttgaaaatgagttggctataaaaatgtagatttatttctgggttctctattctgtttcattggtctacgtgtgtatctgtattccagtatcggtctgttttggttactatagctttgtagtataatttgaagtcaggtggtatgatgtctccagctttgttttttttttttttttggtttctgtccttgattctattgatgttgatatgtcatgtttattgatttgcatatgttgaactacccttacatccctaggatgaattctacctgatcatggggaagatctttttaatgtgttttttggattctgttttgtagtattttgttgacggtttttgcatctatatttatcagggatattggtctggaattttctttttatgttacatctttgcctgattttggtattatggtaatgctggcctggtaaaatcagtttgataggattccctcctcttcacttttttgagtagtttgggtagaattgatattagttgttctttaaacgtttgatagaattcaacagtgaatcatcaggtcctgagcttttctttgatggaagactttttattactgctttgatcttgctactcattattgatatgttcaggttttctatttctttatggttcaatcttgataggttgtttgtatccaggaatttatccatgtcttctagcttttccaattttttggcatatagtgttcatgatagtctctaatgatcttttgtgtttctgtggtaccagttgtcatttttcctttttcatctctgattttatttatttgggtcttcattcccctttttttttttttttttttttttttgtagtctaggtaaagatttcttgaatcttgttgatcttttccaaaaaacaactttttgtttcatttatcttatgcacttttgtctaaatttatttatttctacattgatctttatttctttgcttctattaactttggatttgatttttttaaaaaaatttggttctttgttttagttccttgaggtgcatttttaggttgtttattttttttctgtttttttatgtaagcatttattgctacagatttcctttttagcactatttttgctggatcccatagattttgatgtatgtcatgtttccattttcatttgttttaagaaatttttaattttacttctaattttttttttctttttacttattggtctttcagaagcacattgtttaattttcatgtatttgtacaacttccaaagttcctcttattattgatttctagttttattccagtgtggttgggcaatatacttgatatgattttgacttttttgaatttcttgagacttgttttgtggcctctcatatggtctgacttgaaaagtgttccatatgtgatgacaagaacatgtattctgcagtagttggatgaaatgttctataaatgtctgttagatctgtttggtctaaagtatagtttacctctgatgtttctttgatgatctggatgatccgttcactgccaaagtgggttgttgaagacccctaatattactgtattgcagtcggtctcttcctttagatctagtaatatttgctttatatatttaggtgctatggtgctgggtacatgtatatttactatttttatttctctcgctatattgacttctttaacaatctataaggatgttctttatttccttttacagtttttgcttaaagtctatttgatataaatacaggtaatcctggtcttttttgctttctgtttacttggcatatatttttccaacccttcactttcagtttatatgtatcttcgtaaagtgagtttcttgtgggcaggatatagttgaatcttgattttttttttcaatccattcagacaacttttgttgttgttgttgttgttttgtgtttttcggtgtttttttttttaaagaaaaatttacctttgttatagattaaagggtacacatgccggtttattacatgggataatttcacgatgctgaggcttggggtcccagtgatcctgttaccaaggcagtaagcatagtacccaacagatggttcttcagtccattcccccatctctctctctccctgctattgatccccactgtctattgttctcatctttacattcatgtatactccatgtttagcttccacttataaatgagaacatgttgtatttggttttctcttctcgcattaggtcacttagtataaaggcctcctgctctatccatgttgctgcaaaggtcattatttcattctttttcatggctgcatattattccttgtaaatgattcctctctattgtaaatgagattgtgctcttgaattggttctcagctggaacactattggtttataaaaatgctagtgattgtcgtacattgattttgtcaattccaggagccttgtgtcagattctttagggtttttcatgtatggactcatatcatcagtaaagagagagagtttgacttttcctatttgaatctctttcatttctttttcttgcctcattgctctggctaggacttccagtactaagttttttgtttttgagacagagtcttgctctgtcacccaggctggagggcagtggcacgatctcagttcactgcaacctctgcctcctgggttcaagcaattcttgtgtctcagcctcccaagtagctggaattacaggtgcatgccaccacgcccggctaatttttgtatttttggtagagatggggtttcaccatgttggccaggctggtctcgatctcctgacctcaaatgatccacccacatcagcctcccaaaaagtgctgggattacaggcatgagccaccacacctggctgatttttaaaagagtttccagtaagttttagttactatgttcattgtaaggattagtctaaataatgtatcccatcattaagtctcagttgctagtatttttcctctaattaattcagtatgtatttccttagaataaagaccttctcacagacaacctggtttagttaacagaaatgagggtatttaacattgatataacactattgtctagttcaaggtccgcattcaaattttatcagtcctaacaatgtcttttgtaaaaaaaagtttttccccttgcctgtgttcaaacccagatcatgcatggttttcatgtccccttagtctcctttcatttggaatagttcctcgatgtttatatttcttgaccttgatactttagaaaaatacagaccagctattttgtataatttccctaaattttgttttatctcatgttctcacattattgggttcaagttatgcattttcacaagaccactgtagtgatgatgtatactcaattgttgatatttggatttttgccattttttttgtttaacatttttatttgacccacctaattgttgggggttttttaaaatttcattttaatttctcatttttaattaattatttatttatttttgagacaagatctgttgtctcaaaaacagaccttgtctgttgtccagggtatagtgcagtagcacaatcatagctcactgcagcctcaaatccctgggctcaaggaattctcctgccttagtctctgggtaactgggactataggcgcatgtcaccatgaccagatacttttttaaaaaatagtttttagagagggggtcttgctgtgttgcccaggctggtcttgaacttcagggcttaagcaatcctcccatgtcagcctcctaaagttctgagattacaggtataagccaccgtccccagccttcattttatttattagctttttaactgtacctttctgtattttttaaattcttttttccaaggattatcatatcttatcacagtttaaagttaatattgtactacttcacttaaaaataagaacctttcaaaagtataggtccacttatctcctcatcctttgtgctattattgtcatatatatctacttacattaaaaaaaagtctgtgcaggcatggcttttaaaattcagaaaaatagtatgtatgtcttaaatttacccacatctttactatatctggaactgttcatttctccctgtaggtcagggtttccacgtggtattgtttctctttagcctgaagttcttttagcttgtgtgcatctactggttgtgaattctcttagctttggtttatatggaaatgtgttaccttcgcttttgaagggttattatcttggagataacattctgctgacagtattttcccttcattacttcgaagtatctcctcttgttttctgctctccattgtttctgatgagaaatcagtcaacatttgtatcagtgttccactatatgtaatgtatcttttctttagaccagttttgaatttttctctttgaatttcagtaatttgcttattatgtgcctaggtatatttctttttcttttcttttttcctttttttttttttttttttgtgatgaagtctcgctctgtcgcccaggctggagtacagtggtgcgatctcggctcactgcaacctccgcctcccgggtttaagtgattctcctgcctcagccttccaaatagctgggattacaggcgcccaccaccacgcctggctaatttttgtatttttttagtagagacgggatttcaccatgttggccaggctagtcttgaactgctgacctcgtgatccacccgcctcggcctcccaaagtgctgggattacaggcatgagccactgtgcccgaccatgcctaggcatatttctttgtatttatcctcccttgagtttattgagcttcctagattttataagtttatgtttttcacccaatttggcaaaatttagttattatttatttaaatgtctttttctgtctcatctctttcctattctcaactgcaatatcttacatattatttgttatgttccacagttcactgaagctttattttaattcttttcctgtgttcttccgatttgataattactattgatctgtcttcaaatttggtgactaaacatggtctccaatatgctattaaaccatgtagggatttttctcaattattgcacttcttagtacagtaaatacaataatttccattggttcatttttatagtttcagtatctgtgtaagattcattgtctgtttattcgtatggcactattttcctttacattcttgaatgtatctttaatagctgtttattgcctttgttcactttgttccagtatctgtgattcatatgggggtcaaggtctatagactgcttttttttcttggctatgggtcacaattccctgctttttctatgtgtaataattttttattacatagtagacatagtaaatgaggaattgtagagattctgtactcttctgttcctctgaagagtattgacttttgttctattaggtctgtctccttcaatgtggacagaagctaaaatcactgccctattttttcagctttcagatgttattgtttttgagcctcctggagtcagtgaccagacaataatttggtcagaggttatcctcaaatttaggggcttctctgtggctgtcttattttcaggagtaccccctaattttgcagctgctctgctagtcccaacctatgttctctgaaacttcaaaccagtgagcctgtggctttttgccagcctgtgatgcatggattgagaagtaccctccagcataagctcacaaatctctctttttagtggtgacttctcttcagttcctttggaggagctttcaaatcttttttttatgttttgtccagaacatataattgttacctgtgagagggttacttcaaattattccactataaatggaagccagaattttcctacccttaaattttttttttaagatgagtctcactatgttgcccaggctgtctttgaactcctgggctcaagtgattatcccacctcagcctcccaagtaggtaggcctattgacatgagccatcatacccagttaattttttaactttttgtagagacggggtcttgctgtgttgcccaagctggtctcaaattattttcctgcctcagcttcccaaagcactgggattacaagtgtgagccatcatgcctggctccttaaattttaacaacatatttgaacttacatttttccctcaacacctatacctagtagactattatttatcttctcccttcaaaaaaaaaagttattagtgttgacaatgttggcaggctttcatttcccttctggccaagttgaaaattcatttaggattttagttcctgctttggggattttatttttgtatactattttatctaggggtatgagtataagttcaaaataattttccttcagaagtttgaagatgttccattttcttccagcttaccattattgccagtgaagagcttgttagcaatatattttggggaaggggtcatgatgtgtatatatgttgaaattttaaattttatatacagtaaaattgacttcttgttgtactgttctaagagttcttagaaccattctggctactttcattgtggtggaaacagctcagatttagatcttgcagatttggttgtggaatctgcctatagctctctgtagctctgtaaccttggtaaatttggaacaacatggagtatgaataaagaaaacatctctgtgtcacatttccttatttgcaaaaaaggatgatgccatctttcctgtctaccactctgggatctttcctgaggatcagatgagaccgtgtatgtgaaaacatcttgaagaacataacacttatatgagggaccgtttagtatttccatttgccctcctatcctgtatagatgattcagtaacattgtgtgtgaaaaaaatgatttaagcattatgaactgctgcaatatatagcaaataaggaatcattatactattatcattatgttagtagtggactactgaagactagaaactctcaagagccaaagaagagttgagtttttgtatgccataataaatggaagagtgtgtagggatggaaaagggggggtgtcagaagtacctgcacgtttacaccctgtaaaagattaatacctactttgcattcctctttgttgtctctgcccttggagactcctttactttcataaatatggaatgcttaaacaatgcacccagtttagtgtcggtgtggaaggaagctcatgttgaccctgcaactagattaatgggggaaaaaaaggtctgtcttgagcctgtgtgctttaaccatgtgaaatttattgaaaaaaaaatcaggaatattgagagaaagagttggagcagggaagacaggacagagaagaatggataaaagcatgaatagaagaagaaagataggatgtttgagcatcctaatgctcaggcagaggcagatgtggtcagttgttgactggggaaggaactaaatataaaatgagccaaatagagtgatggaggctttttactgcctgagtcaaaacaagcaagggcccaggcttctagatcttattgcagaaagattgatttcgacagcatataatttgcatcctcgttccatgggagaagaggttcatagatgggcacatgttctcacacccttgaaccatgaattggagttttccacctgaaaggagcagagacagactagtgagcagaaagcttcgtcctccaaccttagcctttatctgtgatgctcagtgtctccatgcaggatggtcaagacctccacttgtccattatcccttctctttctcttctatttgcttcctctgggaacttgccccccatcagttgcccactcctttcttatattgtcagtccgtttctatggactccttttttggtttacaaggatgctcaggttaccccaaatttaaaatactttctcttaatcgtgctactcccctagcactatccttcctttccttacagccttcccagagtctgcctatcctcctcaccttggcccctcacagtttgaatcatgaccctactatgccgaaacctctctcaaaagtcatagagatctactcatcaaattctgcatccttttctcaggacttttttaacctctttgcttgcacatcatactgtggactacaccctttcttttcttttcttttttttttttgagacaatctcgctctgttgcccaggctggagtgcagtggtgcaacctcagctcaccgcagcctccacctcccaggttcaagcgattgtcctccctcagcctcctgagtagctgggattacaggcgcaccaccacacctggctaatttttgtaattttattagagacggggtttcaccatgttggtcaggctggtctcgatctcctgaccttgtgatccgcccacctcagcctcccaaagcgctgggattacaggcgtgagccactgcacctggcctgaaactacaccctttcttgatactctctgcttctgacaaggtcttccccactgctcatctactcctctggatccaattatttctgctctcccaagttgaactgtcacattaccaactaaccgatgatcacctccatgccaatatgctaagggcatctaaaacttactatgcccaaaatgaaactcattactttcctccccaaacctgcttgtttttgtgagtttcctttatatacttcctgtaccacaccttcaaaacctctgtcatctctgattcttccctttgctttttccatccaatttgttgtgaaggtctgtcagttctacttgcaatctagtttgtttctgtcactcggtttccatttatcaaacatttggccgggcacagtggctcatgcctgtaatcctagcactttgggaggccgaggcaggtggatcacttgaggccaggagttcaagaccagcctggccaaaatggtgaaacactgtccctgctaaaaatacagaaattagccaggcaggcgcttgtgatcccagctactcaggagggtgaggcaggagaatcgctggggggcagaggttgcagtgagctgagatcgcgccactgcactcagcctgggtgacagcaagactccatctcaaaaaaaaaattaacggacctagtaaggaactatgctagactctggagaatgcaaagattaataacatcatttgatgtcaagagctgagagagataaaaatagccaattattacatgcaatggaaaaaccatgttatatgctatgctggcaaataaatgattaattttggtattttgattaaggggggcatagtatcaaggaaattcttaggaaggaagtgagactgaactaagctatgaagaattgttagcatttcgattagaaaggaaagaggataatttcaggctgaagcataactggagaaaacatgaaaacatgaaactgttcaggaagtggtgacttgcgtagctggagtaagtgtagagtgtaaacagggatgcagaatgagtgaaaagacatgggagagatgttaataagtctttccatcagtcactcctattaccttttactgaaatattacaatagccctttaacaggttctcttgtgtccactgtaacttgcttctaaggtaatcttcctgaagaagcgctttgaccaacctggatgggctactggctctgccttttcctagtaacaggtctttaggcaagctcctactttgtgaggattaaatgataaagggtattttaaaatgcatatcatactgtctggaagcaataaataaaggagaactattaaattcaaactctttttaactgacactgaagctcttgtatcagctggctccagtcaacctttccaagtttatcttctatgtctctgctcaccatcctcaaaaaactctttgctctttttcctatttacatcctgcacttttctgacttttgctttcattccctgtctctggaatacccatcaaccattgctgtatgactaaatcagtatctctttaatcttgactgcacatcggaattgtctaggagcctttaaaaaaatactgatgcctggattctattcccagagatcctggtttaattgctttggtgcaacctgaacattaggattttttaaagttgctcaggtgattgtaatgtacaaacaagattgagaactcctggcccaaatcgtaaatgttccctcaaagcattttctgaataccaccttctccccatacttctctgcacctctaatctttcctttccctgaactctctgcactttatatgtgcctttcttaagacacaattttctcccttgtgatattgtttcttatttcttacattataacataatctctttgtacacagtttatatttgagtcatctttctgtagttcatggtatgtgtcattaatgttttccgagtgatggtggatgaatgtctgcatgtagaaataggaaaatgacatttctagtgaggaagaagaaaaactacaagaggagtcaggcagtgtggttcctgggatggaaataaccagtatcccttattttagggatgaggaactgagagtaagggtaaagaggtgtgggaatatactcagactggtctggtaacctgtgaacacagacttgtagacagttgtttattagtttatccattcaatatttactaaatgcctaccatatgcttgacattgtgctaggtcccaggaatatatagctatagcttacagtcaatgtcccaatggctcatggggcaatcaacacattgctttaatgggaagagacagctagtctctctgccttctcttaggcctaatgggaagggcatctatctcttcatcagtacctggtggtagaataaagaattctattctttattttctttctttctttattttttttagatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaagttc

SEQ ID NO: 194 - DNA, 54124 bp, Homo Sapiens
ccaggttccatcaggtttttaattgtacatcagtgactgtgaaaaagcaattattcccataattaaaatacaaactataaaaaaacagactcaaagaaaagaaagatgacagagtgaaagaaggtacatttctttcgtgttcaaaccacggagttcacaacacagcagcacacacagctgggcgctttgtggtctcggcaccctcggcttccccttcacggggccgctttcgactagtagaaggctgaaaataaaggaaaatggagaaatgttcaaaagaaaatcactggcttctttaagattatcaaagttcctcaatatgcttccagtaaagtgggggcatttgatgtgaaattctagaaccaaaaattactggttgtcatcattgacaactgagtcctcaccacagcccccaactcagacatgcttatctaatagatatttctctcccttatggcttctgacctctgaacgatgtatactgaaagcaagtagcataaccaacttcctcttgatcgtcctcttctaaatatcaagtttaaaaggactataatacctctcagttgaagccccaagtcttggtcttttgcgggaagacaacctttgtgccttagttgttttcccatatataaaattgggaggaaggctgggtgcggtgactcacagctgtaatcccagcactttggaaagccgaggtgggcaggtcgcttcaggtcaaaagttcgagacaagcctgaccaacatggcaaaaccccatctcacctaaaaattcaaaaattagctgggcacagtggcggacacctgtaatcccagatactcgggagactgaggcaggagaactgcttgaacccaggaggcagaggttgcagtgagctgagattgcaccactgcactccggcctgagtgacaaaccaagactctgtctcaagaaaaaaaaaattggggggaggaaacagtgggaaaaaggacagctaccattcaacaacaacaacaacaacaaaaaagcaggactggaattaacttatactcacaaagaactttaaagaataaaattgtaatcaaggaatcaactactgacccaaattttaatttgttcaacaaatttatatttgagcctctaatagagtctttcgaaattgccttgcaggtgaccttttggatgacaatccctagctgtgcttatcggtctattatgtgttagatattaaacatatcctgcatttttaaatctaagggtgctggagcgaatcaagttaaaacagagtttctactacattataactgaaacaatgttaagcaattgctactcaggaaaatcttgaatttcatcatctttgcttatcagctccttaagcccagactacatttagtgatcatcaggaatacgaatacctgggctagaacctggggtagagctgtggattcattttcctcagacagaagatcttgaaactttctcttcatgtcttcatcctgtgagggaattaaaaacataagtagctgtgtctgaaggataataaactcctagaatgacagggctagcatgcccctgtggaaagagggaggaaaaatgtccgtccaagaatcatccccttgatgaagctcccacagcgaaggcattatgtgttgcccgcctctaccttcccagaggagtctaattagcagtcaatgctccatcaatcctggctgactcacatccacatgcctaaaagctctcagtgggtcaatcacagcctccagcagtcaagagtttcttaattagtatccaagatcctgagaaaggtggcaatcaggaggccagaggctgggcctgactccgtgcagctcctcaaatccttcccggaccactctccacctgctgcccctgccatgaatgaggccagtcacccagactgtcctaacaaccagcccagcaccctaggaaaattcacccagcagatgccatacaaattttcagaagtacttaagcccacagtatcccagagctcaggtctaatgagaaagggagacaataaacagaaccaagtattttgtttctgctgcaggagcgggaggtgaggggtttcatgctgcaggagcaggagatgaggagggcacagacagtgtgtatgcgagtagctcccacctctctggatgctcacttctgcagggttcgaggatttgcattaggaaaccctgagaggtggtctggtgcagctctccccatcttcagcaaggtgaaaggaacatccataactaggaatgtggcctttgagtgctggccagaagcccagctcagccactcacaggtggcatgtgcagaatacagacccagagttatctgattccagtgcctcatgtactttcccacccaactccagcccctcctcccactgagccaagcataccacagtggggaaagggagaggatacagtaaagtcctccaccatttggcaatttgatggatatggaaattttacaacactaggttgggcatggtggctcatgcctataatcccagcactttgggaggccaaggtgggagaattgcttgaggccaggaatttgagaccagcctgggcaacatagtgggacttcgtcactacaaaaaaaattaaaaattaggccaggcacggaggctcacgcctgtaatcccagcactttgggaggccaaggcaggcgaatcgcctgaggtcggaagtttgagatcagcctggctaacatggtgaaaccccttctctactaaaaatacaaaataagcagggcatggtagtgcacgcctgtaatcccagctactcaggaggctgaggcaggagaatcgcttgaactcaagaggcggaggttgcagtaagccaggatcacaccactgcactccagcctgggcaaaagagtacaacactgtctccaaaaaaaaaaaaaaaaaaatttaaattagccagacatggtggcatgcacctgtagtctcagctacttgggaggctggggcaggaggatcacttgagcctgaaagtcatggtgcagtgatcatgccactgcactccagcctaggtgagagagcaagaccctgaggaaggaagaaaggaaagaagcaaggaaggaaaaaggggaggggggacgaaagaagggaggggaaaggaatggaggagaggggagggggaaggaaggaggaagaaagaaagaaggaaagaaggaccaggcacagtggctcacgcctgtaatcccagcactttgggaggccaaggcagggcagatcacttgaggtcactctgttttgagtttctcagtgtagctccccattgccatttgacagcagcaagctcatctggattctactccgcaccctctcacggccttacttaggatctcaattatcttgcagtgtcactctcaaaagtccatctcttggcagcccttcagtgaagccaaacagagtggtcacaagcctaatcaggcctgtatttaaaacaagtaatcaggtcaggcacagtggctcatgcctggaatcccagcactttgggaggccaaggtgggtagataacctgaggtcaggagttcgagaccagtctgaccaacatggtgaaaccccatctctactaaaaatacaaaaatgagctgggatggtggcaggcacctgtaatcccagccacttgggaggctgatgcaggagaatcacttgaacccagaggtagaggttgcagtgagctgagatcacaccattgcactccagcctggtagacaaaagcaagactccatctcaaaaaaggaaataaataaataaacattgattttcttcatgatgtctacaattattccaaaatattaaattagccaggaacagtggctcgtgcctattatccaagcactttgtgaggctgaggcgggaggatcccttaaggccaggagatcaaggctgcagtgagctataattgcaccagtgcactccagtttaggcaacagaagaagaccttgtctccaacagtaaataaaataaaaattaaattgtaatatcccttgaaagtaaacagaagaaatcctctatttcaggcagtaaatatgaggcagagagtagatgtaagggatgctcccaaaactgggcactctgttaatgacaaaacagagaccagaatccacattcccaacactcagttcagcgacagacccacaaaaccatttggttttttcaaaaacactgaattttcccaaaataaaacccaaactatcactaacagatgttttagatggtcagtcttcatccttgtcttcattcaatgctcattcctcctttcactgcaaaaacaaaaggtggctaaaagagtattccagggagatcctgcaacagagttgaacttcaccttctccttggttgttaataagttttctttgacacaaaaaagtacaagaaagataggctatgcttgctcataaatttcaggcagatgcaaaccctgttcccaggctcaactggccagctctattttttgttagagatgaacacagctcctgtacctctacatttagacccaagagtttccctattaggacacatgaaaagagccaaaagacatgtttctctttttcatcaaaattaaaatccccacatgcaaaggcaccctttgtttccaaacccctttcctccagggtcccactgtttcaaatctgtgtggtctattaaatgctaaatcatctgacagatttcttctggggagactgtagtttccagggcaacatccaaacacatatatgtctttttttgtttgtttgtttgtttgttttaagtttttgttgttctcaacctgagctggcctgagcaaaactgttaggtgtagaggattggaacagagaacagggacagtcttcccagagtcccagaagtacgggtcggaggctggactgcccaaggagttcctggaccagtaatccccagagaaacagcatttagctcaagtaacagcctctagctcaagctaccagttctgtcccccatctccacagaaaacggattgatacagtttggctttgtgtccctacccaaatctcatctcaaattgtaatccccaggtgttgagaaagggacctgttgagaggtgattggctcatgggggcagtttcccccaggctattctcgtgatagtgagtgagttctcaccagatctgacagtttcataagaggatcttcgcccttcacttccttcacaagctctctcacctgctgccattaagacatgccttcttccccttccaccatgattataagtttcctgaggcctccccagccatgtgcagctgtgagtcagttaaacctcttttctttgtaaattacccagtcttgggcagttctttatagcagtgtgagaacagactaatacacaaaccaaaaaaaaattcatagaaaggggcatgtctgtgctgaatggaactgctcattacagaagaccagacatctatcagaaaaacctgcccaatgccgtggctaattctaaaactaaagattaacccagcaaagccacaacatacttccaactcttggcagttccagatgaggtcagcatttaaaaatggcagccccaacccctagcaggagcacagcggtaatacagatgaaaagtgcaggtgacagccttcattaaggacacatttactcacctgaatgaacaagcagtgggaccctttatacccagtcacttgggcttgagaaatagctggattctccccagggaggctgtcctcctccccctcccccacttccctgatttaaggttgaagatggctggaatgcaccccacctatgaagagcagtggacatggctgggggtagagccagaacaagcactcaaaagaacacaggccaaacaggagactcggggcagccaagtggaaccagaacaggacataaagtgagcgtgtacatccaacagccatgagtaatatcaaaaaggttgtagcctggccagcacggcgaaaccccatctctacaaaaaatacaaaaagtagctgggcatggcagcatgcacctgtaatcccagctacttgggaggctgaggcaggagaatcacttgaacccgggggccagaggttgcagtgagctgagatcgtgccactgcactccagccagggtgacagaacaagaacctgtctcaaaaaaaaaaataaaacaggttgtaacccatcctccaagataccccccatacatctaaaacaattagattaaacactcaacaaagtaaacatgtttctgtcctctgtctcatgtctctcaggcagcagggcttcccatgtattttatgctagcaggcactgtcccacacccacctgaagccacgggtgtcttaaggcttcttctgtcgtaaaacgtgcctttggatccactaccaacaacttcttgacaaggtccagagctaaagcaacaattgggcaaatcacagtgaaaaggataaatatattatcagtaagagtatgccagaattaacaggccaccattcagaaagagcagagagggtctgagatcatcacggagtcagcagacagggccccctaatcttcctcactctctgtattcagagtactgtgagaagaccaggaatgataatgacactccctgtctcctgctgctgggacgtcagtcacgacctcttcactgcctgttccctctcttgttgctagactcaaggtcggactaattaaagctaaacttctacccaattctaagatacttgggatgcacagcaaactctctctgacatctacagatggataggtgacagttactcagcgagggagaggctccctggaactgcagacttgtcagaaataaaacttggctactccagcaagcaacaaatgcacgctggcctgtatattacaacattattattccttaaatattctgacatttaacacaatcacctatgttatgttatttgacatttaattttctactttctcttcagggaactaaagttgccaggataaattataaaatacaaggtaactaatgacatctagtttttacatgcttgcttactcaaaggaaaccttgtaactaaaaagttacaagtgcatttattttgctcactaaaataggtaccaggcacttgtgtacatgatacttaaccctcacaaaaaccttttaaggtagggtttattgagggtccctttacacagaaagaaattggagatggaggttaaataacttgcctaaggccacacagctaagtagtagcagacccaggacctgagtgcatgctcttaataatttccagtgcctctcaaatggtgtgaaactaacaatagaaaataagaacagaattgacaggagaaaacaccatggaatttgggaagaaactcccaccacagcacatacacattttagcataccacaaattcttaaccctttcatattcatacctttctctgagacttctgcccagacttcaggaatgaagttgtattttccactggtgatctgatccttcagtgacacttgagtcctatgctcagagaaaggtggatacccactaaggcttaatattggtagagagagaaaggaaaagaaatcaagtggcattctcagtggcattcagatataaagatttctttttcagcataatgaaaagtcagatttttctttaaatcaatggtcaaaaagtgagctaggctgggcacaatgccttaggcttgtaatcccagcactttgggaggccgaggcaggaggatcacttgagcccaggagttcgagaccagcctgggcaacatggcaaaaccccatcactacaaaaaatagaaaaattagctgggcatggtggtgtgcatctgtagtcccagctactcgggaggctgaggtgggaggatcacttgacccaggaggcagaggctacagttagccaagatcaagccactgcatgccagcctggacaacagagcaagacacatttgtgacttcatctaatcacctcctaccagtctgtgcagcaatgaaaatatttcttaccagataaaaagaataactcctaaactccagcagtccacagcacggttatacccagcagtcccaacagaaacaagaacttcaggcgccaagtaggtgggggttccacataaggttctcatgagagaggtctctcccaaaatcttggagtgcccaaaatcagtaatctaaaattcagtacaaaagggaataatgttgaacttgccataaaataaaaagattaacatagtctgccagtccaagaagacacgtaggctagatcagtttctattgtacaattcacacctgccattaatctggaatttacagattcatgtctttgcaagttaggacatttaattttgcttaaattaaaattcctgagcctaggaatctcaacactcaggctttccaacttaacctatgtcctctgtaatcttacaaaaagcttattatctttatcacagacacttcaggattctaattagttctacatggttcttagaccccagtgtctcaaacttggctgcgctatggaatacctggggagcttggaaacacatgcttatacctgagtgccactctcagcttctgaggtaaagcctgggtgtcataaatcctaacaagagattctaaagtgatgccagacttgagaaacagggaaaggcagcgcatgtgattactcattcattcattcacctattctgagatgatgtctggcccttttgcacaggctggagtgcagtggtgcgatctcagctcactgcaacttctgcctcccaggttcaagtgattctcgtgtctcagcctcccaagtagctgggattacagacacccaccaccatgcccagctaaatttttgtattttttgccatgttggccaggttggtctcaaactcctgacctcaggtgatctgcccacctcggcctcccaaagtgctgggattacaggtgtgagccaccatacccagcccactcgtccatttagacccctcctctctctctaagcacaaaggtcacttgtacacaacagagctcaataaatgctcattcgaatctggataagagcagtatcacctgatctctaaaataattggtaacagtgaaagggtcagattctcatcctttttacgctcccactttttatttgaggaattaaaagtttctgaacaagaatctacaggaatagccacatacagaatgccaatttcttacctttataagacagtcctcttcttgagatgacagtaaaacattctctggctttaagtcacggtgtataataccgttttcatgaaggtactacacagaaaggcaggcatgaccctcagattcatgcagtagatacttaagtagaatcaaagttaccaacacacacatctcacagctgggtgaaaccgtaagccgtgatacacacaaccatattctccaaaatcatagaaaactgttggggtaaagtttacaaatttgtttgagaagatctttaaaaagcagggaaatgaaaaaagcaacttagaacaattaacctttcatttcactttaagataataaacaactcttcacacagcagaaatgtaaggtgtcaatttcaataaaaattcaaatgggtaacagaaaatgttttgagaacataccaaataaacacaaaaattccaccaaaatgatatatttggttattgcagtcctgagaatatttttaaagggaacctatacaaatatatatttgtaaatatctatttatgtgatacaaatatatatctgtttatgtgagttaacctattcctcaatgcaaagactttgtctttgaaaaaactattgtctgaaatagcatataaaaatgaacaaacaccaacatactatgccatatttcttttcttttcttttctcttttttttttttcttgaaacaaggtctcactctgtcccccaggctgaagtgcagtggcaccatcttagctcactacagcctcaacctcctcagctcaagtgatcctcccacctcagcctcatgagtagctaggaccataggcacaaagcatgccacttcaaccagctaacttctttatttttttgtagagacgggatctcacaatgttgcccaagctggtctggaactcttgggctaaagtgaccttcccacctcagcctcccaaagtgctgggattacaggcatcagccaccctgcctggccatatttttttaggaaacaaaattttcacatatccacaaactgtactcaattcatgttaatattcttggttactcaatataaataaatggaataaaccaataagggagcaatacactgagtaggtgacagctaccattaaaaagggcttgcgttgtaccccataaacatgtacacctactatgtgcccacaaaaattaaaattaaaattaaattttttttttaaaaaggcttgtgggcgggcacggtggctcatgcctgtaatcctagcactttgggagctcaaggcaggcggatagtttgaggtcaggagtttcagaacagcctggccaacatggtgaaaccctatctttactaaaaaaaaaaaaaaaaaaattagctggacatggtggcaggcacctgtaatcccagctactgggtaggctgaggcaggagaatcacttgaacccgaggtggaggttgtagtgagccgagatcgtgccattggactccagcctgggcgacacagtgagacatcatctcaaaaaaaataaacaaataaaaataaatttaaaaggcttgtgtttatgggcttcaatcttctctggatgtccctctgggttagaacaaaaattttttgcaaaatctttactgggaaatggatctggtgaaacctccagggagggcaaacctaggtagatcaatcataaaaaaatttctctcgatcctcactctgtacaaggattgctcccaatcactgcatttcctgcaaggagtgggttttcaagaagagactggaagggaatggccacaaccacatttggtctgggaaatggtgatgttcctcaaagcaagtgccaccagctattctttcatctaacacctactgaatagagatggctatgtgcattccctgccggcccgcccactgcagcgaacaggatgctgcacctgaagggaaacacctagttctgagccatgggggaccaacccatctgtcacaatcatcacaacttgcagctctgccctcaaacctgcccagctcccactctgagttaagagagacttctacaaggatcaagcagaactaaagaactaatgatcaagacccctccagaaatacctccaagctaaagataggcgacatagggccatgttatctctttttttaaagacagagcatcattctgttgcctagactggagcgcagtggcatgactgtggctcactgtagcctcaacctcccaggctcaagccgtcctcccaactcagcctccagagtggctaagaccacaggtgcccgccaccatgcctggctatttttattttttgtagagatgggggtcccattatattgcccaggctggtcttaaactcttgggctcaagtgatcctcctgccttggcctctcaaagtgctgggactacaggcgtgagccactatgcctggtctatttatttctttaattccctttcttactttctcttaagctacacagtgagagctttttcttttttttttttttttttttttgagatggagtctcactctgtccccaggctggagcacagtggcatgatctcagcacactgcaacctccacctcccagttcaagtgattctcctgcctcagcctcccgagtagctgggactacaggcacgcaacactacacccagctaatttttgtatttttagtagagatggggtttcactatgttggtcaggatggttttgatctcttgacctcgtgatccgcccgcttggcctcccaaaatgctgggattatgggcatgaaccaccgcgcctcgccagtgagagctttttcatctcagtgaaaggagtaggacatttttgccaagaagagaacagcaaacacacagattctcttctgagttttaatccacggtccctcgatttctgcctaattcagggagtaattcaactaaaagaaaggcagctgtcaaaagaattgagggcttcttttacctgcacagccaagagcatctggtaaaaatagagcttgcaggtagcttctttcaggcgtttattccccaccactttgtcaaacagctctcccccttccatcctgaaacacaaaggcaaggcaaggggttcattcctgggggaaaacgcacttggacagaagacaataaaacaacaaaacaaattcattaagacaagcaaacagttgacatttttattcacttttgactctcatttttaaaactaataaggtttattcacaatcagatgtcccagttggaaactaaggaatgagatgaaaggattgggcattggaggcacctggggaactttaaaaaatccaattcagtagcttggaagtggggcccaggagttgcttttttttttttttttttgagacagagcctcgctctgtcacccaggttggagtgcagtggtgcgatcttggctcactgcaacctccgcttcccaggttcaagtgattctcatgccttagcctcccaagtagctgggattacaggtatgcaccaccatgcccggctaattgttgtattttttttagtagagacaaggttttgccatgttggccaggttggtctcaaattcctggcctcaagtgatctgcccactttgccctcccaaaagtgctgggattacaggcataagccaccgcacccagtcaggagtttgcatttttatcacacaccacagatgattctgagactgatgtagaagagcaaacagaattttacaaacagacaaccaggatctgaaccctaactctaccatttcccagcttttggactttgggaaagctatttaacctctctcagcttgtttctaccacttaaaaaatggggatgataccatctaccttgatggttgttataaaaattaagagatggctgatgtaggaaaagctcctggcacaggtgcttggcaaggttattcctttatttatttatttattttgagacagagtttcgctcttattgcccaggctggaatgcaatggcgcaatcttggctcaccgcaacctccacctcccaggttcaagcgattctcctgcctcagcctcccaagtagctgggattacaggcattcaccatcatgcccggctaattttgtatttttagtagagatgcggtttctccatgttggtcaggctggtctcgaactcctgacctcaggtgatctgctcccctcggcctctcaaagtgctgggattacaggcgtgagccaccgtgcccggctctgtattatcacttttattaactgtgttaactggattcagtcaggtaacaatctcctatttgatagcagcagatccacaaggggctccaggctctcccagtgctgtgatcaggggtgatcaggggtgtttttaccatagtcttttttcttttttcttatgttttttgagacagtcttgctctgtccatcacggctcactacaacctccgcctcccaggttcaagcgattctccacgcctcagccacccaaggagctgggactacaagcacatgccaccatgcctggctaatttttgtatttttagtagagacggggttttgccatgttggccaggctggtcttgaactcctggcctcaagggatccgcccacctcagcctctcaaagtcctgggattacaggtgtgagccaccacacccagcctgttgtctatacagtcttaatgatcaccctgcatagatacgatttgccaaccaggagcaaagcattctgtgcctgccacaatagctgctcccagaaacacttaatatttatgcaggagcagatatcaagacaggcatcttccagaaatgagacaggaagttattctgattacaccaaataacacaagacattatcgccactgaaataaactaccaagacactgaaagatactcaggtgccaccatgcaacctggtcctggattgaaaggacccgcatagaaagtcctacccaggtagatatttcagagtagagctgtccctcagtatccatggggaattggttccaggagctctctcagagaccaaaatccattatgctcaagccctttatataaaatggcgtaagatttgcatataatctatgtatatcatcccatatactattttttttttttttgaggcagagtctcactcccattgtccaggctggagtgcagtggcacaatctcagctcattacagccttgacttcccaagctcaggtgatcctcccacctcagcctcctaaatcacagggattccaggcacgtgccactatgcccggctaattttgtgtgtgtgtgtctgtgtgtgtgtgtgtgtgtgtgtgtgtgtgtgtgtgttttgtacagatggggtttcaccatattgcccaggctgtatcctgtatactttctttctctatttttttttttttaattttttttgaaacggagtctcgctctgtcacccaggctggaatgcagtggcgcgatctcagctcattgcaagctccgcctcctgggttcacgccattctcctgcctcagcctcccgagtagctgggactacaggagcccaccaccacacccagctaattttttgtatttttagtagagacagggtttcaccgtgttagccaggatggcctcgatctcctgaccttgtgatccgcccgccttggcctccctaagtgctgggattacagatgtgagccactgcgcccggcctttttttttttttttttttaattttttgatatggagtctcactctgtggcccaggctggagtacagtggcacaatctcagctcactgcaacctctgcctcccgggttcaagctattctcctgcttcagcctcctgagtagctgaagtaacaggtgtgcgccaccacactcggctaatttttgtatttttagtagagatggggtttcatcatgttggccaggctggtctcgaactcctgacctcaggtgatccacccacctcggcctcccaaagtgctgggattacaggcgtaagccactgcacctggccctggatactttaaataatctctaaaatacttacaaaacctaatacaatgtaaatgttatgtaaatagtggttctacagtactgtttagaaaataataacaagaaaaatgtttgttcatgtttggtacagatacaaccatccattttatttttctaagtattttcgatctgaggttggttgaatacacggatgtaaaaacccacagttatggtgagccaattataacaatattgccccatggtgagtacacacatgtgccaggtgctctgctgggggatttccatccctcatagcatttaattcatacaaggactctgcatgtgggggttcattataatccccatttaacactatgaagatgagactcagaaaagtgagttaaactgacccatgggtggtcagctagtcaactgcagagtggagttcaagtcctgatcatagatccaggacctggaatcccataccacctatttttggaaacattggagggttttttgggttgatattaaccccctatacacagactttgtgggccccactactacatacatacgttgaggccccccaggatgagaaaggcaagcctacattagattctttggtggctttataaagcatttgaatggaaacagaaatttttaaaaagtttactacttacaattccaaaacaatataataatcttctgcatcaaaaaagtttttaatcttgatgatgcaaggctaagaagagggggagaaaaaagggaaagtagtgagaaactcccaagaggaaaaccacaagagcttagaacatctgcccagagggacagggaggccaagaacaggcatctggccccctgcctcagaggcttggaagttcaatcaggggagaaggcagacagaatctagccaactcctcagtgagaacatgcaagaaattttccaccccaccatgatggtgagagactagttcatatttcatatgcaaggatgctacctgggaatgaaggctaggtctcttcccagtcttcttcctcactaccccagagcagaggtactcaaggacagcctaaggaaccctgagggagactgacaagtagcatgaataaaagctgtcaagtaggagcccagccatgctgccaaacaagggttatttaagctctgggcaactggaacctccaggcaattggaccccatggaacaagatcctaccatttttcaaaggaagaggaaaattctaattttataagaactctaaaacacacttgggtcgggggcagagagagagacagacagacacacacacacacacacacacacacacacacacacacacacctatggctgatagttcatgaccactgatcaatgcagggtgcatggagaacactgagggtaaggaagagaatactgcacattttaaaatgcctatacaatatcatgacttcatacttagcacacctattttttttttaatttttctttcttttttttttattttgagacagtctcattttctttttttgagacagagtctcactttgtcgctcaggcttaagtgcagtggcatgatctcagctcactgcaacctccgcctcccgggttcaagctattctcctgcctcagcctcctgagtagctgggactacaggcgtgcaccaccacacccagctaatttttgtatttttagtagagagagggtttcaccatgttggccaggttcgtcttgaactcctggcctcaagtgatccacccacctcagcctcccaaagtgttgggattacagcagtgagccaccacgcccggtgggcacacctattgtttttacgatacagaagtcagaagacagttaagctcagtgggtaaataaaagatttggtgagtattcatcagggacatacaccccagcacattggaggactgtagttatatcagaattaaaaagaaaagagtcatcagattttttggttttagattcaaaagagtggtaaaacttgccagattgatcttcccataatgtgtatttcatcatattcatcactcatcactctgattaagatcatccaatggaaccttcccacaatgaattgttatatagcaatgaatgaatgcccagttttcccaccatagatgggtcttggaagcataatgctgaatgaaaaagccaagtcagaaaagacttcaaagagtatgatacaagttgagcatcccacatacaaaaatacaaaatctgaatactcccaaaatccaaatcttttttttttttttttttgagacggagtcttgcgctgtcacccaggctggagtgcggtggcgagatctcggctcactgcaagctctgcctcccgggttcacgccattctcctgcctcagcctcccgagtagttgggattatgagtgcctgccactgcacccggctaatttttgtatttttagtagagacttggtttcaccatcttggctgggccagtcttgaactcctgacctcgtgatccacccgcctcagcctcccaaagtgttgggattacaggtgtgagccactgcacccggcccaaaatctttttgagagctgacacaacactcaaaggaaatactcattggagcattttggatttcagatttttggatctggaatattcaaccaggaagtacaatgcaaatgttccaaaatccaaaaagattcaagacccaaaaacctctggtcccaggcgttttggataagggacactcaatctgtatcatttttataagattcagaaacaagcagtaaaactatattatttagggatacacatatatgtggctttaaaaaagcaaggggccgggcgcagtggcacatgcctgtaatcccagcactttaggaggccaaggcaagtggatcacctgaggtcaggagttcgtgaccagcctgactaacatggtgaaaccctgtctctactaaatacaaaaaaattagctgggcgtggtggtgcatgcctgtaatccgagctacttgggaggctgagacaggagaatcgcttgtacctgggaatcgcttgaacccgggaggcagagtttgcagtgagcctaaatcgcgccatggcactctagcctgggcaacaagagtgaaactccgtctcaaaaaactaaactaaactaaactaaaaactaaactaaactaaactaaactaaactaaagcaagggacaggccaggcacagtggctcacgcctgtaatcccagccctttgggaggctgaagcgggcagatcaccaggtcaagagatcaagaccaccctggccaacatggtgaaaccctgtctctactaaaaatacaaaaattatctgaattagctgagtgtggtagcacgaacctgtagtcccagctgctcaggaggctgaggcaggagaaccacctgaacccgggagggagaggttgcactaagccgagatcacaccagtgtgctctagcctggcaacagagcaacactccagctcacacacacacacacacacacacacacacacaaagggacagtacacacagcattcaaggtaatggcattacctctgggtaggatggggaaaacataaacaggtagctcgagtcatgtggtcaggttttttgtgtgttttttgttttgttttgcttttgtttttgagacagggtctcactctgctgcccaggctgaagtgcaatggggtgatcatggctcactgcagtctcaaccttctgggctcaagcaatcctcccacctcagcttcccaaagtgctgggattataggcatgagccaccatgcacggctgtaaaaagtaccttttaaaggagaataaagccaggagcagtggctcacgtctgtaatcccagcactttgggaggccaaggcaggcagatcacctgaggtcaggagttcgagaccagcctggccaacatggcaaaaccccatctctactaaaaatacaaaaattagctgagcctggtggtgggcgcctgtaatcccagctagtcaggaggctgaggcagaatcacttgaaccctggaggcggaggttgcagtaagccgagatcatgccactgcactccagcctgggcaacagacggagactccatctcatacataaataaataaacaaataaaggagaacaaaaagaaaagacacatatagaaaaggaacggagagaaggaaaaagggaactgcttggttctggttggcttcataatgggcagtgccagtacctatctgaaaatgggtggggtctggagctaacagagcatgaagaggtgtccgatagtcagaaccagtgtgaattacttcctctagtgtccgctacctccagggtcactgcctggggctgtcacagctaaaagggtctctctaccaggaatcagaagctactaacccacaccttccacttaggtcatactgggaaagcagttcagggaattaacgatctctgtcactctccaagtgtgttgtctgcactgaaagctttaggagtacgtctcattaaattctcacactgaccttgtgacataagtattcttattgtcttcattgtacagctgaggaaacgggggctccaataaataaaatgaacttctcaaacgacttctcagctgctttgatagtactgagacaggaacccagttctgcctccacactaaagtcacactaaagtgagggaagggaaggacagcaatatctgtgcttaccactgccggggtccacaagacaactggcatgacaagtgttcgaaaagtaatcacatcaatctctgactccaaaggtcaggctctcttggccactagactctacttattgtccccaagcatcaaaatgcactcatgggcccatgtttaattcccaagagtttcttgtgcccttgtaaaatgcaaataaatatgtctagaaatcttttttagggttttgaattcttctctattgcactggacaccggatttgtacaaatgttatgtttgaagatcatctgacatcagagaaaattccctgagcatttgtgtttatcttttttttttttttttttttttgtgagacggagtctcgctctgttgcccaggctggagtgcagtggcacaatctcggctcactgcaagctccgcctcccgggttcacgccattctcctgcctcagcctctccagtagctgggactacacgcacccgccaccacgcccggctaatttttttttgtatttttagtagagacgggatttcaccgtgttagccaggatggtcttgatctcctgacctcatgatccacccgccccggcttcccaaagtgctgggattacaggcgtgagccaccgcgcccaccgcatttgtgtttatcttaagggtaggtctgatgcaaccccaccccagaaaattggagggctcctctctcccagcagggtatggtgtggcacatgcctatagtcccagctactcaggaggctgaggcaggagtatcgcttggtcccaggagtttgaggctgcagtgagctatgattgtgccactacactgaagcctgggtaacagagacagactgtctctaaaaatatgtgtgtgtgtgtgtgtgtgtgtgtgtgtgtgtgtgtgttaaagagagactccaaatctcttggaaaaaggacctggcaaattcagagaggacgaataatttgcaaaagaaacagaagaaagccaagcaggaaggtcagccactcaggttctcataggttttcaggtccactcacagagttctaaaggaacctgctgaagtattgtgtcaacaacagtaattgctcctcagtttctactgacttttttgagggatttggagaggtagaaaaagagagaagaaacctttttgctgtttcgaggttaaaagccagaataaggccaggcgcggtggctcacgcctgtaatcccagcactttgggaggctgaggtggggggatcacgaggtcaggagatagagaccatcctggctaacatggtgaaaccccctctctactaaaaatacaaaaaattagccgggcgtggtggtgtgcccagctactcgggaggctgagacaggagaatggcgtgaacccgggaggtggagcttgcagtgagccgagattgcgccactgtactccagcctgggtgacagagcgagcctccgtctcaaaaaaaaaaaaaaaaaaaaaacaaacaaaaaaaatgccagaataagatcatcattagctggacaggagagagatcttgccttgagtttaatgccattgcctaatgagcttatgccttcatgggcacttatgaattaaggaagaaacgggaaaaaaacaaaaaaaagcaagataagattaagcccaccctctaatttttcttctcactttttaaaagtgagacacatttttcattgagacatagtcatcattgcacaaaaagataagaactaggccacagacaccatttaatcagatataaggacaggatgttgtcatacttaatggatacccttggatttatttggattactccaaataaaaggtattcaaaagtggtaaaacttcaggtataactaaaccaaatttactaaaattaacactgtcttctctaatataaccagttgtgtctatgagatagaataattgctatatgttttggtcaagaactaactcagaagaaatatcatttgtttatttaatcatgaaatctttatacggtattgttcactcagtaacattttggggtaaaactcttcccagctaaatgacagctaggcatgtgtgtgaatgtacacataagttaaagaacccaggttaatattagctttatttattcttttaatttttcttgtttttttttctgagacagtctcactctgtcgcccaggctggagtgcagtggcgcgatcttggctcactgcaatctctgcctcccaggttcaagcacttctcctgcctcagcctcccaagtagttgggattacaggcatgtgccaccatgcccagctaaatttttgtatttttagtagacagggtttcaccatgttggccaggctggtctcaaactcctgacctcaggtgattcacccacctcggcctcccaaagtgctagggttacaggcatcagccaccacacctggccaatattatctttattatactgaaaggctttatactcttctcatattttgagatagataaatctaagtatgagtcatataataatacttacatgatttagctttttcaaaatttctatttctgtttcaacattgagagctgggtcctttgataaacagaataacagagtttattagtaataataattgccaatatttaaaaaaacatttacagttaaactcagttgactcaaggctgcctgagttccaaacccagctctacttatacaaagaaatcaaagcccaggtcaatgacttaaatacctcacctaaaataactttgtaaaatgcttggcaaatagtaagcactcaataaatggccaggccctgtgccaagctctttatttacagagatcatgtctcataagcctcagaatccccatcttacagatggggcaaccaaggctcagaaaacagaagccacttgccctagtctccacagtcagaaacaagtgtgtttccactgtgttcattttaattagtaaaccctacttattagctatggaactatttttattcattaaaatgataaacaaaaaacatgaacaagaaggtgttcaattaaactatataaagaaaatgtgaagtcaaatttctgctaatagagcagatacaggttccaacttcaacagcagcctcgcatatttactgagactctgacaagaggaggcttcagggtactaaagttgttctgttacaattccaaaaggatgaatcaagtaactcagcttcctgggctacaccctccacaagcaaagaggagatagaattacatatttatgtaaaatgaacttcagctaagaaacccagatgtttaattttaagagcctgcctcttcctgtaagccgctaaactcattaccaagtcagggtatactctgataacaggatggtcacaaaggtccaatctgattcaaataatgaaatcaaaacgtaaaattttactcccagtttttaacaatctagttggtattttcttctccccaaaatgggaaacaaatcttagaatcataggggaaaagatctataacaaagtgaacacaaaaaggaaattcctcttgccatgtgagaatggcattgtctagggggaaaaaaaattgatctttaaagaatgtgaaagtataatagccagaaacagctggccactagggaaaatgtgattagaggctgtgttttacattactttgttgagtcacatgtggaaagaccaatgcatttggccatctctcccatacagtaaatgttgattacaaaagagtagtaaaataaatggctgctataaagaaaggctatttcaatgatttaattaaaattttaaaaatctatggctaatccataaaccagggatactcactgccatattacccagaacagcaaagaataagaaattacctaaatgatcagccagagaaatggttaagtaaattacaataaagttgatgacatgaaaactcagtcatcaaaaaggatgtattaggcaaaagtctatgctataatgcatttgtggaaaagcaaaatacaaaactgtatatacaagatgatttcaaccatctaaaaacacgatttcatctgaacaaaatctagaaggaaaaggaaaactgaaaacagctgtggggttacagtggggattatggctgaatttttttctctaatttcctgtcatttattgtaaaaacaatcttgtaacgactttgaacttggaagaagaaaaaaaaaaacttcccactatgctcattattatgtacaattaaatacttttggaaccaaattatctataagtaaaagtttctagattaatcaaagatgccccaaaattttccatgttctttgatactcacaaattcatccatctaagcagggggttattcctgagtttaaaaatcatcaatctaagattattttgggaagttatgaagacgtgttaataaaaggtgatcagccttttattggtacttactgcctctcttgctgaaccaatagcaaacttccttttgctgatgatctttatggctactttcttacatgttttcctctcgaaagccagctttacctctccacaggcaccactagagggaaaaacaaagatagtgattgtctgaatgtttttaattatgagacctaccactcctgggtccacttcaagtattagaatttacagacattccatataacagcctttccattgtccctgtttgcagaggacacagtgaaacttcaccagtgtaaaatgtcaagggcttaacagccaaaaacactaagtcagctccaaattccatttctgagcccagcaatacaaacatgggtcttactgtagccctggattgtgaaattcccagaaagatactaagagaaaaatgagagagaaactacgtatccgagaggtcagaaaaacattaactagaaacagtcctccctggtcaaaaataagtgcccaaaacaaacaaataacggtaaacagaatctgcaaatgaataactttaatggataaatttctttccttcttattctccatcttcaaaggaagtgcataagcagttgatgacataagttgcaccctaaatcaaatcagattacctaagaaaccaaacgtattacacaatcagcctactttcagcaacctctcacagagatttgcagttaaatgggatactactcatggaggaggaatgctctccaagccattacccagaacacagttaatcctgagtaggatctgtcctccaaagcttgggtcagcccaagataatggctactagggcatcaattacccattatgaagtagactattataactattgtgggttttgaaggggtgagttgaggggcttaccaagacatcttttttattgtgttaaatatacataacacaaaatttaccactgtaatcattttaaagtgtacaattcagtagcattaagtacatttgccaatgttctacaaccatcagcatctaattccagaactttctcattagctcaaatggaaaccctgtacctgttaagcaattaagcagtcactcctcactctaccctgtccccagcactcagcccccagcccctggcaaccactaatctactttctctaaatattgatttgcctattctgaatatttcatattgatgtaatcatacaatatgtagcctttcgtgtctggattctttcacttagcgtaatgccataacatttgtggtacttcattcctttttacagctgaataatattccattatatggaagtatcacagtttatctattcaccttccgacggacatttatttggtttgtttccaccttttgtaaatggtttcttcagtatgacaacaaaagcataagcaacaaaagaaaaacaatagataaattatacttcttcattgtgactaaagctgctatgaacatttatgtacaagttttctttttttttttttttgagatggagtctcgctcagtcgcccaggctggagtgcagtggcgtgatctcggctcaccgcaagctccgcctcccgggttcacgccattctgcctcagcctcccgagtagctgggactacaggtacccgccaccacgcccggctaatctttttgtatttttagtagaggggggtttcactgtgttagccaggatggtcttgatctcctgacctcgtgatcctcccatctcggcctcccaaagtgctgggattacaggcgtgagccaccgcactcggccacatgtacaagtttttgtctgaacacttgtttgctttttttttgagatataggctcgatctgtcacccaggctggagtgcagtggcacaatctcggctcactacaacctctgcctcctggcttcaagcaattctcgtgcctcagcctcctgaatagctgggattacaggtgtgtgccacctcgcccaactaatttttgtatttttagtagagacggggtttcaccatgttgggcaggctggtctcgaactcctgacctcaggttatctacccacctcagcctcccaaagtgctgggattagaggcgtgagccaccgtgcccagcctggacacttgttttttaaattggggaatttatatacctagaaggagaatttctgagtcacgtgataattctatgtttacctttttctgttgttgtttgttgttgttgttttttatgccccatagagctcagatgtttacctttttaagaaatcaccaaactattttccacagtggctacatcattttacattcccgttagcagtgcatgggggttccaatttctccacatcctcaccaacagttactagtttctgtttccttattatggtcagcctagtaggtaggtgtgaagtggtatctcattgtggttttgatttgtattgccctaatgactaatgatattcagcatcttttgatgtgctttttggccattgtatgtgttcttgagggaaatgtctattcaagccctttgcccatttgttttgttttgtttttagagacaggatctcactctgtcgcccaggctgcagtgcagtgcctttgcccatttttaaatggcaggttgtttgtttttttattgtacagttctaagatgtctttatctattctagacataagcccttatcagatatagggcttgcaaatatttaatcattctgttggttttgttttcacttattgataggtatcttttgaggcacaaaagtttttaattttgattaagtctaatttatctattttttcttttgttgctgtgcttttggtgtcttatgtaagaaaccactgccaaatacaaggtcatgaagagctgtccctatgctttcctcccagagttgtatagttttacctcttatatttcattcttggttccactttgaattaattcttatgtatggtatgaggtaagggtccatgtaactattctttttaaaatcagctcaaagcactttccaatttcccttctcctggaaacagtcaccctttgcctgggaattcctccccaagtccgtgcagctctagctgggtgtctactatggcacaacccctactcctagaaacacaggatagctacataaccaaaactgagctggagcagtgagccatgatcatgccaccgcactccagcctgagacacagagcaacaccctgtcattcattcatacctacagccagagttgcccttgaaatcaaatgctgacattgggagacagacttctctctgttgtagtttctagacaaagaaaatatcattctgcagcccctggtagccatttttcctaccacatagagagaacaattctataggaagccaacaaacagctgaatcaagagatggagctagagccctggtgacactgcaggagctcttagacgcagtcaaccagaccatcagaactcaaagaccatgaagtaaagcctaatgacctcctagatccagccatgcctgaagtaaggatttgcctgcttatttttatttttatttatttatttatttattttaatattttatttttttgagacagggtcttgctctgtcacccaggctggagtgcagtgatgccatcttggctcactgcaacctccgcctcctgggttcaatcgattctcttgcctcaacctcccaagtagctgggactacagacatatgccaccacacccagttaatgtttatatttttagtagagacagggttttactgtgtcagcccggctggtctcaaactcctgacctcaagtgatccaccagcctcggcctcccaaagtacccggattacaggcgttagccactatgcccggcctggctatttcccagttacaaaagccagtaaattttttctcttacctgactcatttgagttgagtttctatcatttgctacaagttagagaattcatattaaatcttcccttaggaaaacattgaattccatacatttcttcttcttttttttttttttcctcccgagacattgtctcactctatcgcccaggctggaatgcagtggcatgatgatggctcactgcagcctccacctcctgggctcaggtaatcctcccacctccaccttccaagtagctgggactacaggtgcagaccgcaacgctcagctaactttttctattttttctagagacaggatttctctattgcccagctgcccaggctggtcttgaactcctggactcaagtgatacacctgccttagcttcccaaagtgctggggttacaggcatgagccaccatacccagcctcatacatttcttttttcttttttctctttttttttttttttgagacagagtctcactctgttgccaagggtggagtgcagtggcgtgatctcagctcactacaacctccgcctcctgggttcaagctattctcctgcctcagcctcccaagtagctgggattacaggcatgcgtcaccacacctggctaatttttatatttttagtagagacagggtttcaccatgttggccaggctggtctcaaacccccaacctcaggtgatccacccgcctcagcctcccaaagtgctaggattacaggtgtgagccaccgtgcccagcccatacatttcttaagaaagggtttgacggttagattccaagcaaccagtgcaaatatggaaacacatcagttactgaattcagtatcagtaaactaaaatttctcccatataatacagaggatactgtgcttaactatgttgcaggaatatggatgattatttccttttatgtactttccttccatgtttccaaaaatatcagtagaaagacctttgtgagacaggaagggggatgaagaacattttgtaatgtggtaacagtatcctgatactttcctaaagaaatggttctcaaagtatgattggatcaccccaaaaggaccccaagaccttgcagggcatccacaaagccacaactatgctcagaataatactaagacattatttgtgttttccattctcattagctcataagtatggagatttccagacactacgtggcgtgtgacaacataacagactgaatgacgaaacaaattacagaatctagccatcttctaactaagccagatgttaaaaaaattttgcaaaaatgttgaacagtgcctctcttctcactaatctttttaataattattttttataaaaaatgttactcaggccaggcgcggtggctcatgcctataatcccagcactttgggggaccgaggcaggcggatcatgaggtcaggagatcgagaccatcctggctaacacagtaaaaccccatctctattaaaaatacaaaaaattagctgggtgtggtggcacaggcctgtagtcccagctacttgggtgactgagtcagaagaattgcttgaacccgggaggcagaggttgaagtgagctgagatcgtgccactgcactccagcctgggtgacagagcgagactccatctcaagaagaaaaaaataaatgtaactcatcttaacatgtagtaaatttacctaatgaattaatataaaaatgtcttggcaaaatgcagtggttcacacctgtaatcccaacattttgagaggctgaggcaggaggataacttgagcccaggagttcgagacaagcctaggcaatacagcaagactcatctctacagtaaaaaaaaaaataaaaattagggccgggagtggtggctcacgcctataatccagcactctgggaggccgaggcaggcagatcacctgaggtcaggagttcaagaccagccaggccaacatggtgaaacctcatctctactaaaaatacaaaaaaattagctgggtgtgtggtggcgggcacctgtaatcccagctacctgggaggctgaggcaggagaatcacttgaacccaggaggcagaggttgcattgagctgagaccacaccattgcacaccattgcctgggcaacaagagaccacaccattgcctgggcaacaagaacaaaactccatctcaaaaaaataaaataaagtaaaaattagccggctgtgatggtgcaagcctgtagtcccagctactcaggaggctgaggcagaagaatcgcttgaacccgggaggcggaggttgcagtgggccaagatcacgccactgcacctcagtctgagtgacagagtgaaactccgtctcaaagaaaaaaaagttatcaccaataaaattcgtgaggcgaaagagttaatttcacctcaaacacatcaaaaatgcacctatcatgatgtatgaaaaatgctcagtatctctagccatcaaggaaatgcaaattaaaaccacaatgacatcacctgaagcctgttagaatggctattatcaaaaagatgaataataacaaatgttggagaggatgtgaagaaaagagaaccctggtacactgttggtgggaaagtaaattagtacagccattttggaaaatagtataaaggttccccaaaaagctaaaattgtaattaccatatgatccagcaatcccacttctggatatatatccaaaaaaaaatttaaatcagtatgttgaagagatatctgcactcccatgttcatttcagcattattcacaatagccaagatagggaagcaaccaaagtgtccataaatgaatgaacggacaaagtaaatgtggtgtatatatacacaatgaaatactatacacatggccaggcacagtggctcatgcctgtaatcctagcactttgggaggccgagatgggtggattgcttgagcttaggagttcaagaccagcctgggcaacatggtaataccccatctctacacaaaatacaaaaattagccaggcacggtggttcaagcccatagtcccagctacttgggaggctaaggtgggaggatcacttgagccctggaagtggaggttgcagtgagtcaagatcgtaccactgcactccagcctgtgcaacagagcaagactctgacactaacacacacacacacacacacacacacacacacacacacaggaaataaaaaaagaaatatttggctgggcatggtggctcacgctactaatctcagcactttgggaggctaaggcaggaggatgggttgagcccaggagttcaagaccagccctggcaacacagcgcaaccccaactctaaaaaacaaaaacacacattagttgtgcatggtgctgcatgcctgatctcccttgacctgggagatcaaggccacagtgagctctgatcgtgccactaccctccagcctgggtaacagagcaacaccctgtctcacaaagaaataaaataaaaataaattaaaatgactgtgtgaaataacacacaaaaataaaaataaaaaataatacacaaatagataccatacaaatgttatcaatacataatgagtgttataaaatcagaaatgagaaaccaccaatcacaaatgtatagtgaaaaaattaagtgcatttatataagaaaataatttaccttccaagagtttttgacatgatgtattcatctcttaatgccttaggataaactgactgatcatctacagtcagatcaaaaaagacaaaaactaaggaagaaaagagtagaaatgggtttcattaatttattcacaagaggcgatcactgattctaaaatttattcatcatatggaatataagaactgtttttaactacatttaacatgtaaccttaaggaaattagtatgtatgtaatataataggtattagtgggctaatacatattgtaaagcccttgagaaataaatgatagtcaaatttcatgcttcaatggaactataagcatcactctgaaactagtgcaaaaaatccgtaacacaacattatttatattccttgacctcagaatatcaatcaattacactaatataaaatgcccatgcagatttacaacaggcccagaatcaaaaagcaatccatcagtctgagcctagaaaaaatggtctaggcaagtaaatatcccaatgaaaattaggccatcagtatcaccatacgggtattatcatctctcagccatttatacctttatatatccggtattaagtattttatagtgcaaaccatattcaacatatttgtaaagctaggtaaataacattttctaaacaaattcccttttttctccattatttgggctgtatcttaaaaaaagtaattttttttttttttttttgagagagtttcactctgttgcccaggctggagtgcagtggcatgacctcagctcactgcaacctccacctcccaggttcaagcaatttttgtgcctcagcctcctgagtagctgggattacaggcgaacagcaccatgcccggctaagttttgtatttttagtagagacgggattttaccatgttggccaggctgatctcgaactcctgacctcaggtgatccacccaccttggcatcccaaagtgctgggattacaggagttagccaatgtgcccagccaaaaaaaaaaaaagtaaaacaactactttttaaattctataacccaggacagtgctgatgatttaataatttaaccacccacgtgggccaagcctgtgataaattatcaaatatttcaattctacaaagtcatcaatgataaatttgcaattgcctatgccatcttgaaaggtgaaatttgttaagacccttgagtttctcagatctcaggtgacaggttttgacctccctagaataacctaaggatccagtctctggcacaaatctgagccacctgagtatatttcattcaggctggtacacaagaggcaggcacttgtctggtgacagacacctgctggccacccaggcacaagtgtccctctatgcttgtagctattcataacgctgtatgttccagtggcatctgagaatgtagaaatttgattggctctcatgatgtatttctcctgtcaaggtttacttcaagggctcaaacgccattgtccacacaagtcaggaaggtaatgtaacagggtcaggctgtgttgagtttaagacaccatggagaagtggggagagaaaacacacctcccatctaaaggaggcagcctctactcagtgcctacagatcctccggttgtgggactatagactcactgtggccacatattacaacttctctaagacatctggatgttcacattaccactgtaagtatcagtaaatgcctaataaaatatctataggccaaatgcagcctgcagaggaccagtctgacctactttaataagggtcacctttagcctatatgacatctttgttcaaattagagaaaacagagatttattgtacaacatggtgattgtagttaacaacaatgtactgttttttgtttgttgtttgtttgggttttttttttttttttttttttgagacgaagtctcgctcttgtaccccaggctagagtgcaatggtgcaatcttggctcactgcaacctccacctcctggattcaagcaattctcctgcctcagacccctgagtagctgggattacaggcgcctgccatcatgcccggctaatttttgtatttttaatagagacagagtttcaccacgttgaccaggctggtctcgaactcctgacctcaggtgatctgccagcctcggcctcccaaagtgctgggattaaagacgtgagccaccgcgccccgccgtatttttgaaaatcagctgagagagtagattttaagtattttctctattaaaaaaaaaaagataaatatgtgaggtaatgcatgttagctcaaattagtcattctacaatgtatacatatttgaaaacatgttgtacatgataaatacatataatttttttgagacacgttcttactctcttgcccagggaagagtacagtggtgcaatcatggctcactgtagcctcgacctcccaggctcaagcaatcctcccacctcagactcccaagtagctgggactacaggaacacagcagcatgcccagctaatttttttatgtttggcagagatggggtctcactatgttgcccaagctggtctcgaattcctggactcaagcaatcttcctgtcttggcctcccaaagtgctgagattacaggcatgagctaccacgccagcctataatttttatttatctattaaataaattttttaatgtttatttaatttttttaaaagaggaagaaaagtgccctttgagtagaccaatgagaaggtggcacacagcttgtcaaggagaggacagaccaaatttcagcacccagttgcctcctcccctaggtacccacaaacagcaaaacctaaagcagctgccctgactataactgtcagatagaaaacaaaatggtcgccgggcgcggtggctcacgcctgtaatcccagcactttggaaggccgaggcggaaggatcacgaggtcaggagatggagaccatcctggctaacacggtgaaaccccgtctctactaaaaatacaaaaaattagccgggcgcagtggcgggcgcctatagtcccaactacttgggaggctgaggcaggagaatggcgtgaacccaggaggcggagcttgcagtgggccgagatcatgccactgcactccagcctgggcgatagagccagactccgtctcaaaaaaaaaaaaaaaaaaaagaaaagaaaagaaaagaaaacaaaatagtcaaaatagaaacagggaaaactaagttaatcataaaatgtactttaggatgcccaacatagacatagttccaagataccagactgaagactgacttgcatgaaaatcccttaggcatgactttattttgtttggttagatggggtctcaccatgttgcccgagctggagggcagtggctatttacaggcacaatcatagctcactgtagccttaaaatcctgggctcaagggatcctctagcctcacctttctgagtagcagggactacagactcatgccgcagcccctagaggcatgatttttaaaatccctaccagaatctggagaagagtgcttatatgaacctttattttcaaaatgtgtcgcacacacatagacaccctccaagtcattcgactctcagataagtttgggaacgtctatggtttctttaactaaagaaaaattgtattcctcctgtctaatcacgctgagctacttttaactctattggttgtttttgtcaggtatcctttctagatattacccagaaaaacagttgttcattttagatgttattttcatagtttcagaaatggatgcttataaaatgctacctgatgaggctgataaacatctccacttgtgcacgataaccttgtagtatttacaaaggtagaagctctaaagtgagcctcttacagaagcactcacagcctagtacctggcatataaaaagagctcaataggccgggcgcggtggctcacgcctgtaatcccagcactttgggaggccgaggcgggtggatcacgaggtcaggagatcgagaccatcctggctaaaacagtgaaaccccgtctctactaaaaatacaaaaaattaggtgggcgtggtggcgggcgcctgtagtcccagctactggggaggctgaggcaggagaatggcgtgaacccgggaggcggagcttgcagtgagccgagatcgcgccactgcactccagcctgggcgacagagcaaggctccgtcacaaggaaaaaaaaagaaaaaaaaaaaaaaggagctcaataaatgtatacagaaataaatgaatagggctggacatggtggctcccacctgtaatcccagcactttgggaggccaaggcaggcagactgactgcttgagctcagaagtctaagaccagtctggccaacatggtaaaaccccgtctctaccaaaaatacaaaaaattagccaggcgtggtggcatgtgtctgtggtcacagctactcaggaggctaaggtgggaggatcacttgagcctgggaggcagaggttgcagtgccactgaactccagcctgggagacagagtgagaccatgtctcgaaaaagaaagaaagaaaaaaatgaatggaaaaaatgaagaaaggaaagaatgaggtgaagaggaaggaaaaatgaattaatggcctgaaacaacaattcatagatatctaagactgatgtggtataaactgaatcaatcaatgaactataacttattttaatcaccatgataattcaattaacagtatatgggccaggcgggggctcacgcctgtaatcccagcactttgggaggctgaagcaggcagatcacgaggtcaggagttcaagaccagcctggccaacacagtgaaaccccgtctctactaaaagtacaaaaaaattagatgggtgtggtggcaggagcctgtaatcccagctacttgggaggctgaggcaaggagaatcgcttgaaactgggaggcagaggttgcggtgagccgagattgcaccactgcactccagcccaggtgacagtgcaagactccgtctaaaaaaaaacaaaacaaaacaaaacaaaaaaaacagtatatggcattacataaaaccaattaaaccttaaaaccttaaaaatctgtctggatggaactttttcataattttacaatgcaactaggacggcaaagttgaatcttgagtgctaacttactcatctttttttttgttttgagacagagtttcactcttgttgcccaggctagagtgcaatggcacgatcttggctcactgcaacctctgcctcccgggttcaagcgattctcctgcctcagcctcccgaatagctgggattacaggcatgcaccaccatgcccggcttattttgtatttttagtagagacagggtttctccatgtgggtcaggctggtctcgaactcctgacctcaggtgatccatccgcctcagcctcccaaagtgctgggattacaggtgtgagccaccacgcccagcaacttactcatctttactcacttaaaccatattctgtaaggacaggacaaattttcctcctatgagagagtggaaaaaaaaaattccagtaaccataagataataatattacctttatttctgcttagtgacagtgcaatttcagaattgttattcaaaggacggcgttttcctttccctacaagctctgtatttacaaaggttccattgccactgtgatcttctatgtatgcaatgtaagagtttttaggacccacttcctaaaatagagaacattttgtttcagactttgaatagcagagatttatagtgggaaaatatctaaaaacaatgaccaaattaccagctctcctagatacatgggtattcattacctaccctgaaaatccgaaagtgtttcttgctgtatgttcggtatttatctgttcttttcagcagtggttcatcaaagcaatattcacagcttttgtccctcccaaaccagtagttgtcattcacacattctgtaatataaaagcatgcatcagagggctgttgaatttcatgtatcaaacgtttaaaaattgctcataaatgctaattgtaggaaaatagcctaagaaggcaatcagaattatcaatctgcttatcaagattttacaagattaaaaattaggagagaaaaaacaacattaccaatgagtttaacaaatggcagtttatctataaccacatggccaggcacagtggctcacacctgtaatctcagccctttggaaggctaaggcaggaggatcacttgaccccaggagctcatgaccagcctgggcaacatagggggcacccatctctaccaagaatttaaaaattagtctgggcaacatggtgaaaccctatctctacaaaaaataaaaaatcagcagggtgtggtggtgggtccctgtggtctcagctactcaggaggctgaggtgggaggatcgcttgagcccaggaggtcgaggctgcagtgagctgagactgcgccactgcacactagcctgggcgacagagtgagacccagtttcaaaaaaaaaaaaatggccaggtgtggtggctcatgcctgtaatcccagcactttgggaggctgagacgaatggatcacgaggtcaggagttcaagaccagcctggccaagatggtgaaaccctgtctctactaaaaaatacaaaaattagctgggcgtggtggcgggtgcctgtaatcccagttactcgggaagctgaggcagagaattgcttgaacctgggaggtggaggatgcagtgagccaagattgcgccactgcactccagcctggacgacaaagcaagactctgtctgaaaaaaaacaaaaaacaattaaccagatgtggtggtgcatgcctgtagtccagctactcaggaggctgaaggaggaggatcacttgagcaagataagctgatgctacaatgggctgtgatcctgccactgtactccaacctgggcaacagagcaagaccctgtctcaaaaaaataaataaacaaatatttaatatatattatatatttattttatatttattatatataatatatataatttgtatttattatacatgttatataaatttattttataagttgtcttaaatataattatatatttatacacaatataacatatattatatatttataatatagtaattatatctaaatatataataatatataatatatattataatctattaatatatgtatttatatacacaaacacacacatacacatacatatatatataaaaccgtgaaataacaaatagtcattaaaagttctcgagtaatttttaatgacttggaaaattacttgcaatacagtaatttcctgcttattaccttcctgaggttttccatgacacttagcataaaatctgcactcttcctcatggcctactagatgctcagggtctggcgtctgccaccattccagccccacctcatacccctctccccttgctcatgacacccagcaccactggcctcctttcactgcccccaagaatgctgggttcaatctgccttgtggtcttagcacttcttccccaactacacaaatggctcattccaccttgccttttgtataacagatactatctacacaacactatctgcctttaggactctactatcatctcccactcagctttctttctttgagatggagtctcgctctgtcgcccaggctggagtgcggtggcgcgatctcggctcactgcaacctccacctcccaggttcaagcgattctcctgcctcagcctcccgagtggctgggactacaggcacgtgccaccatgcccagctaattttttgtaattttagtagagacggggtttcgccatgttagacaggatggtctcgatctcctgaacttgtgatccgcccgcctcggcctcccaaagtgctgggataacaggcatgcgccaccacacccggcctcccgctcagcttgttatataaacattactcacctgttatcataatgttatcctgttttatatctttttgggtatgggccacggctggaaattaccttgcttatttgtatattttctccccacctccctgcattagaacataacctccaggagggcagctggagacctcttgtttaacagtacaactccagcacttgggatattgcacatggcaggtaattaaatgttcattgcaaggcagactagggaaaatactagcaactcctatcaggaaaaggaataatttccctaataaatgttaggttcctataaatcagtgaaaacgctaaacagtccagtagaaaaataggtaaaggatatgaaaagataatttacaagaaacagaaatacagctggctcaaacatatgaaaggtggccaagctaacccaatataagaaaattcagaaatcaaaaacacattaagatttcatgttttacctattagattggcaaaaatccaaaagtttcatatcaccctgtgctggcaagaggtatgaaaaagcgggtactctcatacattgccattgggaatataatttatacacacattgtctataattgtctagggaggacaatttagcaagatctatcaaaattacatatgggctgggcacgatggctcacacctgtaatcccagtactttgggaggccaaggaaggaggatcacttgagcctgaaggtcgaggctgcactaagctgtggttgcaccactcactccagagtgagagtgagaccctatctctagaaagaaaaagaaaattaacaaatccaaatttagttagttaaaaagatcaacaagttggcaaaccttagacagactgaacaagaaaaaaagagacaagactcaaattactaaaattagaatgagagagataattactactgatctgacagaaataaaaatgatttaaaaagaataattgaacaattgtgtgacagtattagatgacataggtgaaatggacaaactcctagaaagatacaaactaccaaaactaacacaagaagaaacagaaaatctgaatatacccataagaagtgaaaagactgaatgataatcctagcacattgggaggccaaggcaggcggattgcttgacttcaggagattgagaccagcctgtgcaacatggcaaaatcccgtctctactaaaaacaaaacaaaaaaaaatttagccaggtgtggtggcgcgcccctgtagtcccagctactctggaggctgaggcacaagaatcgtttgaacctgtgaggcagaggctgcagtgagccaatattgtgccactgcactccagcctgggtgacagagagagagactctgtctccaaaaaaacaaaacaaaacaaaagactgaatgagtaatcaaaatatccctacaaagaaaagtgcagtcccagattgcctcactttagcttgagcaacatagggacaccccatctctatcaaaataaaaaaattagccacacatggtggcacatgcctgaggtcccagctactcaggaggctgaggtaggagttgagcctgggaggtcaagcctgcagtgaaacgtgatagtgggtaacactccagcgtgggtaagagtgagaccctgtctcaaaaaaaagaaaaaagaaacacacggctggcttcattttaaattctatcaaatatgtaaagaactaataccaattattctcaaacttttcgaagaaattcggaacggaacactgtcaactcatctatgaggccagcataccaaaaccagacagagacatcacagtaaaaccacaaaccaatatcccttgtgaatatagatataaaaatcctcaacaaaacagtagcaaactaaatccagcaacacataaaaaagattacaaatgaccaaacaagaattaacccaggacgccaggcgcggtggctcacatctgtattcccagcactttgggaggccgaggcgggcgatcacgaggtcaggagatggagaccatcctggctaacacggtgaaaccccgtctctactaaaaatacaaaaaattagccgggcgaggtggcgggcgcctgtagtcccagctactcgggaggctgaggcaagagaatggcgtgaaccccagggggcagaccctgcagtgagccgagatcacgccactgcactccagcctgggcgacagcgagactccatctcaaaaaaaaaaaaaaaaaaaaaaaaagaattaacccaggaaagcttggttggtttaacatctgaaaaccaattaatataatacacgataacaatagaatataggaaaatagacacagaaaaaaattttggcaaaatgcaacacccttttataacaaaaaatactcagaaaactaggaataggagtaaactccttcaacctaataaagagcttttattttatttattatctatttatttttaatttagaggcaaagtcttgctctgtggcctgcaatcatagcttgctgcagtctccaactcgtggccttaagcacttctcctgccataggctcccaaagcactgagattatagggtgaaagagtcagagcaaccagccagaaagcattttttttttcttttgagtcagagtctcactctatcaccaactagctggaactacaggctcctgccaccacgcccggctaattttgtttttgtatttttagtagagacggggtttcaccatgttggccaggatggtctcgatctcctgaccttgtgatccgcccacctcagcctcccaaagtgcttggattacaggcatgagccactgcacccaccccagaaagaacttttatgaaacatccacagcttagtcttcagatatcagaggagaaaggagagaggaagagagaagaggagagagaagaggaaagaaaagaggagaggagaggaggggaggggaggaaaggaaagcggaagggaaaggaaaggaaagcggaagggaaaggaaagcagaagggaaaggaaaggaaaggaaaaaagaaaggggaaaggggaaaggaaaaggaaaagggaaagagaaagggaaagggaaagacccacagctaacatcatacttagactgcaaactggccggggatggtgcctcacacctcttatcccagcactttgggaggctgaggcaggaggatcagatgacagcaggagttcaagatcagattgggtaacatggccagactctgtctctacaaaaaataaaaataaaaaagttaggccagccacggtggctcatgcctgtaatcccagcactttgggaggccgaggcgggtggatcacccgagggcaggagttcgagaccagcctggccaacatggtgaaaccccatctctactaaaaatacaaaaattagccaggcatggtggcataagcatgtaatcccagctacttgggaggctgaggcaggagaatcgcttgaaaccgggaggaggaggttgcggtgagccgagatcatgacattgcaatccagcctggtgacagagcaaggctccgtctcaataaataaataaataaaacttaaaatgaataaaggaccttaattaaacataagagctaaaactaggccaggcactgtggcttatgcctgtaatcctaacactttgggaagccaagatggatgtattgcttgagctcaggagtttgagaccagactgcaacatgatgaaaccccatctccaccaagaatacaaaaagttagctgggagtggtggtgcacatctgtggtcccagctactcaggaggctgaagtgggagaattgcttgagcctgggaggcagaggctgaagtgagctgagattgtgccactgcactccagcctggatgacagagtgagatcctgtctcaaaataaacaaacaaacaaacaaacaaaaatttaaaaaaaggaattaaaactgtaaaattttaaaagaaaacataggtataaataattaacaaataataataataaacagcctcggccagacgtggtggctcgcgcctgtaatcccaccactttgggaggccaaggcgggcagatcacctgaggtcaggagtttgaaaccagcctggccaatatgatgacaacccgtccctactaaaaaatacagaacttagccacggtggtgggcacctgtaatcccagctactcaggtggctgaggcaggagaatggcttcaacccaggagattgaggttgcagtgagccaagatcgtaccactgcactccagcctgggtgacagagtgagactccgtctcaaataataataataataataatgataaacagtctctatttattcagcacctactttatgctggtcatcctatcaggatctttgtttacttgtctttttttgtttttcctttttgtggagaatggggtctcgctatattgcccagcaggtctcaaactcctgggttcaagctatcctcccacctctgctgctctaagagctgggattacagttgagagcccctgcacccagcctctttgttttcttacttttaaaggtgatgtatcccatttagccctttctcaccatttctatttctcactcatctaaacctataggcctatctgaaaaaatatattgtattttatttatttgtttattttttggagacggaatctcgctctgtcacccaggcgggactgcagtagcgcaatctcagctcactgcaacctccacctcccaagttccagcaattctcctgtctcagcctcctgtgtgggtgggattacagatgcctgccacaacgccccgcaaatttttttttcttttttttttgagatggagtttcgctcttgttgcccaggctggagtgcaatggcgagatctcggttcactgcaacctctgcctcccaggttcaaccgattctcctgcctcagcctcctgagtagctgggattacaggagcccgccaccatgcccagctaattttgtatttttagtagagacagggtttctccatgttggtcaggctggtctcgaactcccgatctcaggtgatccgcccatctcggcctcccaaagtgctgggattacaggcatgagccaccacgcctggcctaatttttgtatttttaacagagacagggtttccccatgttggccaggatggcctcaaactcctgacctcaggtgatccacctgccttggtctctcaacgtgctgggattacaggcatgagccacaatgcccggtctgaaaaatatattttaaatcagttaaaaatagcttcgagtgtctacttataaatttaaagttgtatatgtggaatgcaggtatattcctccattttttatagttttttcaagatatcaaagttagacatgaaataaaacaaggatggtgagtgacaaaacacaaaatgatacatcagtccttcatttctttatattaacatattctatcctgttaatgccaagttcaaatttgtttattaaagaggtcattgcaatgtaagcgaaaggaaaaaaaacactattttttttggccggagtgcagtggtgcaatcctggctcattgcaacctctgcctcccaggttcaagcaattctcatgtctcatcctcctgagtagctgggattgcagacatgcgccaccacacctggctaatttttgtattttcaggagagacagggttttgccatgttgcccaagctggtttcgaactcctggcctcaagtgatcctcccgctttggcctcccaaagtgctgggattacaggcgtgagccaccatgcctggcaatgttaaaatacacacatgtgtattttaaacatatgcagagcaaaacttactattggaaccaggaggtgtcagaaagggtcaacatgtttaaatcacaaggttggctattttgagacaaaaacaagtaacaagtagtcaacaaatggccatctctattctgaacagctctgattctctgaagctgtggcaaaccacagcagaggttaactagtgaagcttttgtgattaggggataatgtttgcaagtttgagtgaatctgcatttttctaggaagagggtccaaagctaccttcagatctttggatggacagcacattgtaaatgtccaattattatttgttgaaagagtaaatgaacagaatccacagcaggtaacagccagggcaacacccaatactgcctctttggttttaccttttatcacattcaaactccagaattattctaagagtggctcaagcattctgctgcaactaactaaggcaggaaaatagggtctgaaggcagggaatctatggccaattcacgcaaacttcctggaatagatgggcacggttgctcatgcctgtaatcccaacactttgggaggccgaagcaggaggatcacttgaggccaggagttcgagaccagcctggccaacgtggtgaaaccccgtctctactaaaaatacaaaaattagccaggtgtggtggtgtgtgtctgtaatcccagctactcaggaatctgagacaggagaatcgcttgaacccaggagtcagaggctgcagtgagccgagccgagatggcgtcactgcacttgtctgtgcgacagagcaagactccgttgccaaaaaaaaaaaaaaaaaaattcctgaaactaaacaaaaaaggaagaatttgcactctggcctatgatccgtccattctaggaccttcatttgcataaggcgtcaatccacaccagtcttggaatggccgagctccaattcactttggcctctaatgggctgtgagccagcacttcatttacataggatgtaaacagtgggagacctctagagggtacttgaaccccagaagactttgctacaagggctctgcagccacttgctcaggcctgctcccatcctgtgacatgtactttagcttctattgccttccacttcaataaatctatgctttcattgcttgttcatgcatgatgttcaattatttgttcaacgtgccaaaaacctggacaactccaatcagaaccttccacctggtaatacaactttctgtaagtgtttttctgaacaaaacgtgatactatacaacaaagggtcttaccaagattggcaaatccatcctgaagggcccataatcgagcccagggggcaggggtaggctcctcaggttcttggtcctcaggttcttggtcctcaggaatagaatagagttcctgagtggacactgtctctaaggagctcagtgtcccagagctggagtgagaggactggctggagtttggcatcgtgctggtagaggagctggatatgccctgggactgtgaggaggagccttgggactgggtaacgctgccatggggctgtgaacaggcactgctgccatgagactgctgagcctcaacatccgactcccgagacatcacgacctcaaaaagaaagtgtccaacaacaaaggtgagtttcaaggcacaagacttaaaattaaaaagtaaatgatgggcctattacaacagcaaaagaaaagaaaaaaaaaaaaacagggcaaacatgctctccaaaaattaaaagtcctaacagcccagacctatagttcttctgggctgagcttttcaccagatcattgtcaccagatcagttttttatctgacagccataaactacagggaaaaacaaattatctgaaggttacaaataagtaaaaagcaataaaattgagctggggggctcataaaagcttacatttgtccaattcttttaaattaagactgaaaccaaaaatgtactgatacaatcaacactacatttaaatttcatatatacagggggccaggcgcgggggttcactcctgtagtcccgcactttgggaggacaagacgggcagatcatgaggtcaggagttcaagaccagcctggccaacatagtgaaactccgtctctactaaaaatacaaaaaattagccaggcgtggtggcgggcacctgtattctcagctactcgggaggctgaggcaggagaatcgcttgagcccgggaggcagaggttgcagtgaaccaagattgcaccactgcactccagcctgggcaacagtgcaagactccgtttcaaaaaaaaaaactcatatatacagtcctcaatttaacaatgcttctatttaacaatgtttagactttctgtgaaagcaatcagtagacacttacttctccaagtcctcacataaccattctggttttcaccttcagtacagtattcaagtaattacatgagatatttaacaccttattataaaataggccaggtggccaggtgcagtggctcacacctataatcccagaactctggggggtcaaggcaggtagatcacctgagatcaggagttcaagaccagcctggccaacacagtcaaaccccgtgtccactaaaaatacaaaaattagccgggtgtggtggcaggcgcctgtagttccagctactcaggaggctgaagcaggagaattgctcgagcccaggaggcagaggttgcactgagctgagatcgcgccactgcactccagcctgggtgacaggagtgaaaccctgtctcaaaaaaattaattaattaaataaataaaattttaaaataaaataaaataggccaggtgcagtgactcacaactgtaaacccaatatttcgggtggtggaggtaggaggattgcttgagggcaggtgtttgagaccccacctctacaaaaaataataacaataatctttgtgttagataattttgcccaactgtaccctgacataagtgttctgagcatgtttaaaggaggctaggctaaactatgacgtttggtatcttaggtgtattaaatgtaatttcaatttaacaatattttcaacttagaatggttttatttagacataatgccattgaaagttgaggagcatctgtgtactttggaaagcaaaagaagacaaaaaatcaggtggcttgatataaaagtcaaaaagaaattgtacaataacctgctgcattactccaaagggtccatttacataaaatgtcactggtaccccttttcccccaggcttgctcctaaagtgaaacacacctgttcgttcaatctatattccctgacacctaaggacccagtgacttaatgaggcagaacacaaaggaagacagctcttaacaactccacctatccctttgtgatgctaaataaccatagggcttatcttttcagcatcctaaatggccttccggccttgatgtaatcttgcaggaaccattcttttataaactggagaccgtaacagaggcttccacccttgtcttagaattaacctgatagacagttagactgtcataacaggctgggtgcagtggctcatacctgtaatcccagcactttgggaggccaaggcaagaggaccacttgaggccacgagttcaataccagcctggccaacatagtgggaccccccccgccccccgtacaaaaaataagaaaattagacatgatggcatgcagctgtgggctcagctactcaggaaggtgaggtgggaggatcacttgagcccaggagttgaaggctgcagtgagctatgatcataccacttacataccagcctgggtggcagagtgagaccctatctccaaagaacagaaaacaaaccaagactctgataacagaaccaccagtaaaatcaaagtaacatccactgctgacctaatcggattaacaaaaaaaagggagggagaggagggcattctcttcctccccaaactcaggctactactctaggagaacataggaaacaacactatagtagtccccaccatcagagggggataagatccaagaccccccagtggatgcctgaaacctcgcatagtacagaaccctatataaattatgcacaactttctttttccttcttcacaatttcacaaatagaagattagttcttaccatagacgttagcagcctcagcatacaaatttttttatttccatattaaattgagatctttcaccttttcagtaaaaggaaacactttacagcttctctttacaatatccaaattgccagcatcttttgctttggggccattattaaatataagggtgacatgaacacaagcactgcaaaaccatgtaatttaagacttatgaactgattatttctttttttttttttttttgaaacggagtctcagtcacccaggctggagtgcagtggcacaattttggctcattgcaacctccacctcctgggttcaagcaattctcctgcttcagccttccaagtagttgggattacaggcgcacaccaccatgcccggctaatttgtatattttttttagtagagacagggttttcaccgtattggccagcctggtctcaaactgcagacctcaggtgatcctcaggtccacctcagcctcccaaactgctaggattacaggcctgagccaccatgcccagccatgaattgactatttcttatgaattttccacttaatagtttcagatcgcagctgaccattggtaagtgaaactactaccgctgataaggagggactaagatacccacactgattgtatttacacagctttcaagatacaaaggttctgccaggtgtggtggttcatgtctgtaatcccagcactttgggaggccaacgcaggtagattgcttgagcccaggaattcaagaccagcctgggcaccatggtgaaatccagtatctacagaaaatacaaaaaattagcagggcatggtggtgtgcacctgtagtcccagctacttgggaagctgaggtgggaggatcacttgagtccaggaggttgaggctgcagtgagccgtgatcgagcctgcactccagcctgggtgacagagcgagaccctgtctcaaggaaaataaaaaagatacaaaggttctgatgagttttctttaaaacataccaggaaggcaatgccaaaactgagtatgccacaccagggactgctggtctaatactacctgagccaggctgagtcttccccacagctttttaagcaagacaggacaactggagaaaatgtgtcaacaagttactatgagagattagaggcaagcggatctggagtcagacacttgagtgaaactgtgcatgactttaggtagatcacaacttctctaaacctgttttctcatctgaaaataagtagacagaccatgaggattaagtgaagtgacgcatgtaatactccccccacccacccatgcttgctatctgggagctattgctattggaaagccatgcagagaagtgagtgaaaaaccaaagtgagggcagcaaaactccaggactgtagacagaaatccagtcccaaaacctataaaactactagaagaaaacactggggaagtgctccaggacactcatcttgggcacaggttttttgggcacagggtttttacgtaagacctcaaaagcacaggcaactaaagcaaaaacagacaactgggatttcatcaagctaaaaagcttctgcacagccaaggaaacaatcaacaaagtgaagagacaacccacagaatgggaaaaaacatttccaaactagccatctgacaagggatgaataaccagaatatataaggagatgaaactcaactgcagaaagacaaataatccaatttaagaaatgggcaagccaggcacggtgcctcacatctgtaatcccagcactttgggaggccaaggtgggtgaatcatctgaggtcaggagttcaagaccagcctggtcaacatggcaaaaccacatctctactaaaaatacaaaaaattagctgggcatggtggcccgtgcctgtaatcccagctacttggtaggctgagacacgagaatcacttgaactcaggagacggagacggaggttgcagtgagccgagatcgcaccactgcactcgaggctaggtgacagagtgagattctgtctcaaaaaaaagaaatgggcaaaagatccgaaaagacatttctcgaaagaagacatacaaatggccaacaggtatattaaaaaaatgctcaacatcactgatcactggagaaatataaatcaaaactacagtgaggcccgggtgcagtggctcatgcctgtaatcccagcactttgggaggcggaggcgggcagatcacttggggtcaggagtttgagaccagcctggccaacatggtgaaacctgtctccactaaaaatatgaaaattagctgggcatggtggcaggcgtctataatcccagctacttgggaggctgaggcaggagaatctcttgaacccgggaggcagaggaggcagtgagccaaaatcgcgccactgcattccagcctgggcgacagagtaagactctgtctcaaacaaacaaacaaacaaaaaaacccacaatgagataccatctcacccaagttaaaatggtttgtataaaagataggcaaaacagatgctggaaagaatgtgcagaaaggggaactgtatagagtgctcttgacataagtaattttatcttagaaaaaggctctatcttatattttaaaaggcattatgccaacagggaccagatgtttgtctaattaataaagactgtactggccatgtacagtggctcacgcctgtaatctcagcactttgggaggccaaggcgggcggatcacaaggtcaggagatggagaccatcctggtcgacatggtgaaaccccaactctactaaaaatacgaaacttagctgggcatggtggcgcgtgcctgtagtcccagctactcgggaggctgaggcaggcgaatcgcttgaaccagggagtcggaggttgcagtgagccgagatcgcaccactgcactccagcctggtgacaaagcgagactctgtctcaaaaaaaacactgtactaaaccagataaggatataaatatgtacacgcttttgttattagtcctcacaagaaaattctttggtcataagagcaggactttattaggtcaaaatggctgtcctaacagacaccatcttgctgtcactcatgattaacacccagtatccgccatcaaaggctctgcccgcatcaaaaactcttccttacaagacactgacaccccagataaagccaaaacactctctttgtccacattgctctccttggactggtttgataaccactttccctatccccttttctccgaatgttaaatgttactttaatgtaagatttttaatctataacatttacatattaaataaatatactattgtgtacggtttacaatactgactgacttgtggaatggcttgagcctgtgtgcccatggctctgaccaccaagtaaacagggagtactacggaaaattgcttccttgggaactccatatagctcgtggcttttacaattaaaataaaacatcaataagtctgatcttgtggaaagacacaaatgtgcatggacctggttatgtctgaccttgcactgttcacatacaccactggtgggaatgcaaattagtatagccactatagagaagagtattgtgattcctcaaaaaattgaaaataggccgggcgcggtggctcacacctgtaatcccagcactttgggaggccaaggcaggtggatcacctgaggtcaggagttcgggatcagcctggccaacatggtgaaacctcgtctctactaaaaatactagccgggcatggtggcgggtacctataatcccagatacttaggaggctgaggcaggagaatcgcttgaacccaggaggcagaagttgcagtgagcccagatcgcgccactgcactccagcctggcaacagagagagactccgtctcaaaaaaaaaaaaaaaaaaaaaaaaggtacagatggtaatcatatatgtatactttatatcaaaaataaataattttttttaaaaattccagaggtctttcaagtgaaacacaatatttttttcaagcagaaaacctaagtccgaaggaggactgatgccctcctacccacttctggccaccctatcccatacatttacttagggacttatttagggacacgcagaacatcctcctacacagctcagtgcgtttccagtccctgcagcgcccagtagctaagactggcttctctataagtattttatagattgaacctaaagaatggcaacgatttctaacatctatagaatttttacgaagtcacttcgctctgatattgaagaatacaacgctgttcttcttatcctgtatgttcaggcctgtttcagcttgcaagtaatacgggaagtgaacttcacctcgaggatgatctactgaaaaggaagagagtcgcccacacactcccccttcagctcaaaactacagacaaagcgaagctcaggagactccgttcgcacaaaacgcttaagatgggattcgaaccaccaaacacccaacagaagttccccatatgactcaccgcgtgagcccacctggagccgcacactctccgcagcctcagccagcagagtggcgctaaacctgcagatacaaactccaccctcagccaatcaaaac

SEQ ID NO: 195 - DNA, 19149 bp, Homo Sapiens
cacccctcagacacacaggtggcagcaaagttttattgtaaaataagagatcgatataaaaatgggatataaaaagggagaaggaggggaagggtggggtgaaaatgcagatgtgcttgcagaatgtaaaagatgttgacccttccagctggacgtggtggctcacaattgtaatcccagcactctgggaggctgagacaggtggatcgcctgagcccaggagtttgagaccagcctgggcaacactgtgagaccccatctctacaaaacatgcaaaagttggctggccatggtggcatgaacctgtggtcccagctactccggaggctgaggcaggactgctcgagccggggaggcaaaggctgcagtaagccaagatcacgccactccactccagcctgggcaacaaagcgagacccagtctcaaagaaaaagaaaaaaaaaaaaaaaaaagaaaaaagaaattgaccctgagcataaaacaagtcttggtggatccagatcatcatatacaagagatgaaatcctccagggtgtgggatggggtgagatttccttttaggtactaaggttcaccaagaggttgtcagacagggtttggctgggccagcagagacttgacaactccctctacctaaccagctgcccaactgtagaaactaccaacccaccgaccaacagggagagggaacaagcaccctcaagggggtcaagttctagaccccatgtaataaaaggtggtttcaaggccagatgtacattatttcattaaccctcacaatgcactctgtgaggtaggtgcaaatgccagcatttcacagatatgggccttgaagttagagaaaattcaacagtgagggacagcttccctggttagtacggtgaagtgggcccctacctagaatgtggctgattgtaaactaacccttaactgcaagaacatttcttacatctcccaaacatccctcacagtaaaaaccttaaaatctaagctggtatgtcctactccccatcctcctccccacaacaaaacaccagtgcaggccaacttgttcagtggagccccgggacaaagcaaatggaagtcctgggtgcttctgacgcacacctattgcaagcaagggttcaaagacccaaaacccaaaatggcaggggagggagagatgggggtgggaggctgtcagtggggaacaagaagtggagaatgtcagtctgagtcaggcccttctgtcttgaacatgagttttttatggcgggaggtagactgaccctttttggacttcaggtggctgtaggagacagaagcagggaggagagatgacatcacatgagtgagagggtctgtgccccttttccctgaccaatgctttgaagggcctaaggctgggacaacgggaattcaaatcaagatggtggccacaccccatgcaaatatgtttactgagcacctcagagtattagtgtgtattagtctcgtaatcttcccttaccccattttactttatttatcttttttgagacggagtttcactcttgttgcccaggctggagtgtaatggtgagatctcagctcaccgcaacctctgcctcccgggttcaagcgattctcctgcctcagcctcccgagtaggtagctgggattacaggcatgcatcaccacgcccggctacttttgtatttttagtagagatggggtttctccatgttggtcaggctgggctcaaactcccgacctcaggtgatccactcgccttggcctcccagagtgtgggattcgtgagccactgcgcccggcccccttaccccattttatatataaggaaactgagtttgacgggggtcacctaggacctgccggtgcatggcagggctgagtatatgacctgaaactctggctgtattcagtattacacaattattaggcccctccttgagaccctccagctctgggctgggagttgcggagaatggcaaagaagtatccacactcgtccctgggtttggatgttctgtggatacactgaggcaagaatgtggttataggattcaaccggaggaagactaaaaaaatgtctgtgcagggctgggacccaatgagatggggtcagctgcctttgaccatgaaggcaggatgagaatggaatcctatggctttccaacctaggaaggcaggggagtagggccaggaaggggctgaggtcactcacctggagtgagccctgctcccccctggctccttcccagcctgggcatccttgagttccaaggcctcattcagctctcggaacatctcgaagcgctcacgcccacggatctgcagcaacagaggagggggagaagtaagtatatacacagtacctgagttaaaagatggttcaagttacaattgtttgactttatgacggtacaaaagcaacatgcatttagtagaaactgcacttcaagtacctatacagctgacttttaaaaatatttatttatttattttgagatggggtctcactctgttgcccaggcgggagtgcaatggtgcaatcttggctgattgcaatctccgcctctggggttcaagtgattcttgtgcctcagcctcccgagtagctgggactacaggcgtgtgctaccacacctggctaatttttgtgtttttagtagagatggggcttcaccatgttagccaggctggtttccaactcctgacgtcaggtgatctacccacctccacctcccaaagtgctgggattacaggtgtgagccactgtgcccggcccttttttaaattttagagatgatgtcttgctatgttgttcaggctggactcaaactcttgggctcaagagatcctcctgccttagcctctcaagtaactgggactacatgtgcatgcgactgtgcctcgtttcttttcttttttttctgagacggagtctcactctatcgcccaggctggagtgcagtggcgccatcttggctccctgcaacctccgcctcctggttcaagcgattctcctgcctcagcctcccaagtagctgggattacaggcacctgccatcacgcccggttaatttttgtattttagtagagacggggtttcaccatgttggctaggctggtcttgaactcctgacctcaggtgatccacccgcctcagcctcccgaaatgctgggattacaggcgtgagccagtgcgcctggccttttctttttttgagtctcgctctgcgcccaggctgtgcctggctcgactgtgcctcctttcatgcaaccatgctgtttctcactttcagtaacaatattcaataaatcacatgagatatacaacattttattactataaaaagggctttgtgttagatgactttgcccaactgtagggtaacttaaatgctctgaacacgtttcaagtaggctagggctgagtgtggtagctcatgcctgtaaccccaatacttggggaggctgaggtggaaggattgattgagcccaggggtttgataccagcatgggcaacgtagcaagaccttgacttcacagaaaataaaaaattagctgggtgtcgtggcatgtgcctgtagtcctagctacttgggagggtgaaatcaccggagcccagggaggtcaaggctgcagtgagctgagatggtgccactgcactctagcctgagtgacagagtgagactctgtctttaaataaataaataaaaattagccgggcgtggtggctcacacctgtaatcccagcactttgggaggccgaggcgggcggatcacatggtcagaagttcgagaccagcctggccaacatggtgaaaccctgtctctactaaaaatacaaaaattagctgggcgtggtagcaggcgcttgtagtcctagctattcgggaggctgaggcaggagaatcacttgaacccaggaggcagaggttgcagtgagccgagatcatgccactgcactccagcctgggcgacagagtgagactgagtctcaaaaaaataaaataaaataaaataaaaataaataaataaaaattagccaggcatggtggtgcaggcctgtagttgaagcaacttgggaggctgagctgggaggatggatggagcctgggaggtggaggctgcagtgagctgtgactgcactactgcactctatccagcctgggtgacagagcaagaccttgtctcaaaaaagtaggctagagaccagcctgggcaacatagtgagactctatctatctacaaaaaattttaaaaattagctgggtatggtggtgtatgcctgtggtcctagctactggggaggcagagttagggggattgcttgagcccaggagggtataatgagctatgatcacatcactgtaatccagcctgggcaacagagcaagatgctgtctccattaaaaataaaataaaagtaggctaggcaggccgggtgcggtggctcacgcctgtaatcccagcactttgggaggccaaggcaggcagatcacaaggtcaggagttcgagactagcctggccaacatggtgaaacctcatctctactaaaaaaaaaaataaataaataacaaaaaattagctgggcgtcggggcaggtgcctgtaatcccagctactcagtgggctgaggcaggagaatcgcttgaacccagaaggcggaggttgcagtgagccgagatcccgccactgcactccagcctgggtgacagagtgagactctgtctccaaaaaaaaaaaaaaaaaaagcaggctaggctaagctatgatgttccttagattaggtgtattaaatccattttcaacttacaatattttcaacttacgacgagtttatcaggaagtaacaccatcgtaagtcaagtagcatctgtatcaggcaaagtcatagaaccattttcatgctctctttaacaattttctttttgaaagctggtctggtcctttaaaatatatattatggtataagttggtgttctgaagttagttagctacaaccaggagccattgtctttgaggcatcactgccccctgatggcaaatgccccaattgcaggtaaaacagtcaagaagaaaacggcattttgagtgttagactggaaactttccacttgataagaggtcccaagacttagtacctgaagggtgaaatattctccatccagtggtttcttctttggctggggagaggagctggtgttgttgggcagtgctaggaaagaggcaaggaaaggtgataaaagtgaatctgaggcataactgcacccttggtctcctccaccgcttcttgtcctgcttgcttacctcgcttagtgctccctgggggcagctcgtggtgaggctcccctttcttgcggagattctcttcctctgtgcgccggtctctcccaggacaggcacaaacacgcacctcaaagctgttccgtcccagtagattaccactactcaggataggaaaagagaagcaagaggcagtaaggaaatcaggtcctacctgtcccatttaaaaaaccaggctccatctactcccaaccacccttgtcctttctggagcctaagctccagctccaggtaggtggaggagaagccacaggttaagaggtcccaaagccagagaaaagaaaactgagtgggagcagtaaggagattccccgccggggatgtgatgagaggtggatgggtagtagtatggaagaaatcggtaagaggtgggcccaggggtcagaggcaagcagaggctggggcacagcaggccagtgtgcagggtggcaagtggctcctgacctggagtcttccagtgtgatgatggtgaggatgggcctccggttcatgccgcccatgcaggaactgttacacatgtagttgtagtggatggtggtacagtcagagccaacctaggagataacacaggcccaagatgaggccagtgcgccttggggagacctgtggcaagcaggggaggccttttttttttttttttgagatggaatctcgctctgtcgcccaggctggagtgcagtggcgtgatctcagctcactgcaagctccaccgcccaggttcacgccattctccttcctcagcctcccgagtagctgggactacaggtgcccagcaccacgcccggctaatttttttttgtatttttcagtagagacggggtttcaccgttagccaggatggtctcgatctcccaacctcgtgatccgcctgccttggcctcccaaagtgctgggattacaggcatgagccactgcgcccagccaagcaggggaggcccttagcctctgtaagcttcagttttttcaactgtgcaatagttaaacccatttactttgcacatctcatggggttatagggaggtcaaataagcagcaggagaaagcccccctactgctcacctggagggccactgacaaccacccttaacccctcctcccagagaccccagttgcaaaccagacctcaggcggctcatagggcaccaccacactatgtcgaaaagtgtttctgtcatccaaatactccacacgcaaatttccttccactcggataagatgctgaggaggggccagacctaagagcaatcagtgaggaatcagaggcctggggaccctgggcaaccagccctgtcgtctctccagccccagctgctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagtactgtaggaagaggaaggagacagagttgaaagtcagggcacaagtgaacagataaagcaactggaagacggcagcaaagaaacaaacatgcgtaagcacctcctgcaacccactagcgagctagagagagttggcgtctacacctcaggagcttttcttttttttttttttttttgagatagggtcttgctctgtcactcaggctggagcacagtggtgtgatcacagctcactgcagcctccatctcctggcctcaagtgatcttcccacctcagcctcctaagtggctgggactataggtgtgcaccaccatgcctggctaattttttgtatttttttgtagagacgaggtttcatcatgttacccaggctggtcttgaactcctgggctcaggtgatctgcctgccttggcctctttgagagtgctgggattgcaggtgtgagccaccaagcctggtcaggagcttattttcaaaagccaaggaatacacgtggatgaagaaaaagaaaagttctgcatccccaggagagatgctgagggtgtgatgggatggataaaagcccaaattcaaggggggaatattcaactttgggacaggagtcagagatcacacattaagtgggtaaactataaaaaaacactgacaggaagccaaagggtgaagaggaatcccaaagttccaaacaaaagaaatgcagggggatacggccaggcattgaagtctcatggaagccagcccctcagggcaactgaccgtgcaagtcacagacttggctgtcccagaatgcaagaagcccagacggaaaccgtagctgccctggtaggttttctgggaagggacagaagatgacaggggccaggagggggctggtgcaggggccgccggtgtaggagctgctggtgcaggggccacggggggagcagcctctggcattctgggagcttcatctggacctgggtcttcagtgaaccattgttcaatatcgtccggggacagcatcaaatcatccattgcttgggacggcaagggggactgtagatgggtgaaaagagcagtcagaggaccaggtcctcagccccccagccccccagccctccaggtccccagccctccaggtccccagcccaacccttgtccttaccagaacgttgttttcaggaagtctgaaagacaagagcagaaagtcagtcccatggaattttcgcttcccacaggtctctgctagggggctggggttggggtgggggtggtgggcctgcccttccaatggatccactcacagtttccataggtctgaaaatgtttcctgactcagagggggctcgacgctaggatctgactgcggctcctccatggcagtgacccggaaggcagtctggctgctgcaagaggaaaagtggggatccagcatgagacacttccaaccctgggtcacctgggcctgcagagaaggaaccccctcccccaacaccatgccagtgtctgagacagctcggcttcctgtggagcaggaaaagaatggctgcttcacattctctcttccaatgtttcaccacaacccaagcactcctgccccacccctcaccagccatgcacttctttgaggaaaagacaatcagagagggacttccaaccttcccaccactaaatccccaagacttcctaaatgtgcaccctattcccaactcccttcctgtattttttttttttttttgagatggagtctctctctgtcacctaggctggagcacagtggcatgatctcagctcactgcaacctctaccttccgggttcaagccattctcctgcctcagtctcccgagtagctgggattacaggcgagtaccaccacacccagctaatttttgtatttttagtagagacagggctttgcatgttggccaggctggtctcgaactccttacttcaggtgatcggcccgcctcagcctcctaaagtgccaagattacaggtgtgagctaccgtgccctgctcccacctcctgttaacaaggatatagtcattctcagcctgcaatctctgtatggggaaggacacccccttggcccccacccttccccacctgatacacggctccatttctttgattcctttcactgcaaagcttctggaagaacaactgtctcaccgctcacctgcccattctcttcggacactcctcagccctgcattacaaacccctcacgaatggcccgtctcggcttctttaatctcatctcttaacaaccactccctcttccccaaaagctctagctagactggctgcccttctctgctaatcaactggtggttccttggctagccaggaacatgggggtaggctccttcccgtgcagactttaagtcatcctattttaattcacatcacctcatttgcattctcatagcacttacattgtctgatacttttccttgtttattttatctgtttcctctaatagcatatacacttcctaagggcagggcagtgatctatcttgttgtcttgctgaccaaagtattagatcacaatgccttgcacctgcttgggctcaataaatgtgaataacacacaagcctgttatatgagaggttaagagagcgagaaagagcaaggggcagcccctgtgtggaccagcatcttgcacgaagttatgcaactatcatcgcaccttctcccagacaagctttcaaaggctttgccatgttttcttttgttttgtttttttgtttgttttttgagatggagtttggctcttttcgcccaggctggagtgcagtggtgcagtctaggctcactgcaacctctgccttctggtttcaagcaattctcctgcctcagcctcccgagtagctgggattacaggcccctgccaccatgcctggctgattttttgtatttttagtagagacagggtttcaccatgttggccaggctggtgtggaactcctgaccttgtgatccacctgcctcggcctctcaaagcgctgggattacaggtgtgagccactgtgcctggcccgccatgttctttctttctttcttttttcttttgaggcagggtcttgctttgttgcccaagctagggtacagtggtgcaatcatggctcactacagcctcggactcctgggctcagtgattctcctgcctcagcctcccaagtagctgggaccacagaggcctgcctggctaattttttagtctttttctttttctttttttttttggagacggagtctcgccctgtcacccaggctagagtgcagtggtgtgatctcgactcactgtaacctccacctcccagattcaagcgatcctcttgcctcaacttcctgagtagctgggattacaggcgcccaccaatgcgcctgattaattttttgtatttttagtagagatggggttttgccatgttggccaggctggtttcgaactcctgacctcaggtgatcctcccgcctccgactcccaaagtgctgggattacaggtgtgagccactgcacccggccaatttttgagtttttttgtagaggcagggtttcactatgttgcccaggcaggatgctctctttctttttctttttttttttttcagggatgctctctttctttatgccaaatttgtcatcagatttgctaagaaacatgcctactgtaagtgtttgttacacttttctgtttttttttttttttgagacagagttttgctctcgtccaggctggagtgcaatggtgcgatctcggctcaccgcaacctctgcctcccaggttcaagcgattctcctgcctcagcctcccgagtagctgggattacaggcatgcgccactgcgcccggctaattttgtatttttagtagagacggggtttctccatattggtcaggctggtcttgaactcccaacttcaggtgatccgcccgccttggcctcccaaagtgctgggattacaggcatgaaccactgtgcccagcccacttttctgttgtttgcactgacaaaacatcccctaccaaacagctcctttaatggcaggctcttttctttttttattttattttattttattttattttattttattttattttgagacggagtctcagctcttattgcccaggctggagtacagtggcactatctccgcttactgcaacctcctcccggattcaaatgattctcctgcctcagcctgctgagtagctaggactacaagcatgtgccaccacacctggctaattttgtacttctagtagagacggggtttcaccatgttggtcaggctggtcttgaactcccgacctcaggtgatccaccccccttggcctcctaaagtgctgggattacaggcgtgagccaccaagcctggcctacctagtactctgtgtattatgggaaatgtagagttgaggaaagtgctgggcacacagtaagagctcaacaaaggttagctctttctgcaattgttctatttcacttgttctatattattattctagagagaactgtgtgattgttagtgcggatctgtggtactgctcccacccccactccattaatgcaagtacacctccttcagggatctattcagtcaacaggccaggaggtgctgtcctgaaatggggggcccaaagtctcaatcccacttggagggacacaggtctacagacaggtctccctgtctttatctctcaaatcttcagtagcaactaaaatctccgtgtttttcagagcaggaccttcccaggggtaccagcatcagtgggccaggatacaaatgtgccaggctgaactaggccttccaaatggccagggagccaagagaaatgcaggtgcccttggctgggtgggaaggcaatgagatcaactgagaccccaaacaggggcaggcctgaccagaatcttaacagtggctgctggtatcagtcttgaaggcctatatgtccagtgattccctaaacaatatagtacaagtacttacatacatacttgcatgtacattagcattttcattgtatgggggtaatgtaagtaatctagagataatttaaactatatgggaggatatgtgtaggttaaatccaaatactataccgtcttatatatgggacttagacatctgtgggtttggtgtgtgaggagtcccagaaccaagcccctacagatagagggataactatattgccctgtaacctgcaaccctgctatatttatttattagttttggtagctttttatggattttccattaggacttttttttttttttgagatagagtttcactctttttttttttttttgagacggaatctcgctctgttgcccggcgtggtgtgcaatggcatgatctcagctcactgcaacctccacctcctgggttcaagcaattcttctgtctcagcctcccaagtagctgggattacaggcgcccaccactacacccagctaattcttgtatttttagtagagacggggtttcaccatgttaggttggtctcaaactcctgacctcaggtgatcggcctgcctcagcctcccgaagtgctgggattacaggcgtaagccaccacaccctgccggagtttcactcttgttgcccaggctggagtgcaatagcgcgatctcggctcactgcaacctctgcctcccaggtccaagcaattctcctgcctcagcctcctgagtagctgggattagaggtgcccgtcaccacgcctggctgattttttgtatttttattagagttggggtttcaccatgttggccaggctggtcccagggaagccacctgcctcagcctcctaaaagtgctaggattacaggcatgagccaccacgcctggccccattaggacatgtatgtatagaatcatactggctgtgaatgtgttttatttcttcctttctaatcgttattttttttctttccttttttttttttttttttgacatggaattttgctcttgtcgcctaggctggagtgcaatgggacaatctcggctcactgcaacctctgcctcctgggttcaagtgattctcctgcctctgcctcctgagtagctgggactacaggcgttcaccactacccctggctaattcttttttttttgagacggagtttttgcttttgtcacccaggctggagtgcaatggtgcaatctcggctcactacaacctccgcctcccaggttcaagcgattctcctgcctaagcctcccaagtagctgggattacaggcgcccgccactacgcccggctaatttttgtatttttagtagagatggggtttcaccatgttggccaggctggtgttgaactcctgacctcaggtgatccacccacctcggcctcccaaagtgctgggattacaggcatgagccactgtacccggccaacgcctggctatttttttaatattttaatagagacgaggtttcaccatctttgtcaggctggtctccaactccagacctcaggtgatctgcccacctcggcctcccaaagtgctgggattataggcgtgagacatcgggccactaatcattatttctttttctttttttttttttgagacacagtcttgctctgtcgcccaggctggagtgcagtggctcgatctcagctcactgcaagctccgccccctgagttcacgccattctcctgcctcagcctcccgagtagctgggactacaggcgcccgccactacgcccggctaattttttgtatatttagtagagacagggtttcaccgtgttagccaggatggtctcgatctcctgacctcgtgatccacccgtctcggcttcccaaagtgctgggattacaggcctgagccaccgcacccggccctcattatttctttttcttgcctggttaaaacctccagtatggtatcaacgttgtgagagtcaaatccttttctagttcctgatcttagaggaaaaagcgttgagttttcttttcttttttttttttttttttttttgagacgaagtctcactctgtcacccaggctggagtgcagtggcacgatctaggctctgcaagctccgcctcccgggttcacgccattctctcgcctcagcctcccgagtagctgggactataggcgcccgccaccatgcccggctaattttttgtttttgtatttttagtagagacggggtttcagcatgctagtcaggacagtctcgatctcctgacctcgtgatccgcccgcctaggcctcccaaagtgctggcattacaggcgtgagccaccgcgcccggcagcactgagttttctaccattatgtatgctgctagtggaactccgactgtggacgccctgttatcaaactaggttaagtttcctttccctagtttgctaggaggttggttggtttgtaatcatgcatatgtgttgaatatcattaactgcttttgctacatctgttgaaatgatcatagggtttttatgtttccctttgttaatgtggtgaattacacagactgatttttttccccccagtaaagaccagtctgactatgttgcccaggctggtcttgaaatcctgggctcaagagatcttcctgcctcagcctcctaaaatgttgggattacaggcctgagctactgcaccaggccaatttttgaatgttgaatcagctacaatcatgagataaacattatttggttagaatgtatttatcctttttctttttctttttttgagatggagtctcactctgttgcccaggctggagtgcaatggtgtgatcccagctcagtgcaacttctgcctcctgggttcaagcgattctcctgcctcagactcccgagtagctgggatttcaggtgcccaccaccatgcccagctaatttttttttttttttgagatgaagtcttgctctgtcgcccaggctggagtgcagtggcacgatcttggctcactgcaacctctgcctcccgggttcaagcaattctgcctcagcctcctgagtagctgggattacaggcaggtgccaccacaccggctgatttttgtatttttagtagagatggcgtttcaccacattggtcaggctggtcttgaactcctgacctcgtgatctgcccacctcggcctcccaaagtgctgggattacaggcgtgagccaccgtgcccagcctgatttttgtatttttattagaaacggggtttcaccatgttggtcaggctggtctcaaactcctgacctcaagtgatctgcctgcctcagcctcccaaagtgctgggattacaggcgtgagccaccgcgactggcctatttatccttttttctatattaccaggtttggtttgctaaaattggttagctgttgcatgtctatgctaacaggaatattggtctatattttcttttcttataatgtccttgtttggttttggtaccaggattatgctggcttcgaaaacaagttgggaaatattcctctattttttctttctttctttttttttctgagacagggtctcactctgttgcccaggctggagtgcagtggcgcaatctcggctcactgcaacctccgcttcccaggttcaagggattcttgtgcctcagcctcctgagtaactggcattacaggtatgtgtcaccacgcctagctactttttgtatttttagtagagatggggtttcgccgtgttggccaggctggtctcgaactcccgacctcaaatgatcccctgcctcagcgtaccaaagtgctgagattacaggtatgagccaccgcgcccagtctgttcctctgttttctgaagagtttgtgtaagatgggtactgtttcttcctccaacgtttaaagagagcagagaacagaggagataaatagaaaatagcactaagaggtcaggcatggtggctcacacctgtaatcccagcactttgggaggccgagatgggatgaaagcttgaggccagcagtttgagaccagcctgggcaacatagtgagatcctgtcaatacaaaaaaataaaatagttagctgggtgtggtggagtaatcccagctactcgtgaggctgctagaggactgcttgagcccaggggttcgaggctgcagtaagccttgattgtgccattgtactctagcctgggcaacagtgtgagtccctgtctcaaaaattaacaaagaaaaaaagaaaatagcactaaaatggtagccctatactccaactgtaaaataattaaaattaaaagcattcagtagagaaaggaagcctatttcaacaagtggagacagaataactggatttccatacaggaaagataccagagactgactcctacacctcacaccataaacaattaattttaagaattaattaatggctcaaggaccttactgtaaaacttacaaccataaaggtcctaaaagaaaatgtaagataatatcttcatgaccctggggttaaaaaaaaaaaaaaagatgtcctaaacaggacaaggcaaatactgaacataaaaaagataaatccactcctcttaagatactgtaaactctgtaaagcaaacaaataggcaagcaacagatcagaagaaaacattcacgacacatggatctgataaaggacttgtatccagaatgtataaagcagtcccacaactgaacaataaaaacaaacaaaaaaccaaaataacaggtaaaagactcgaagagctactttacaaacaaaatacgaatggccaataggcacatgaaaaaatgctgaacatccttagtcaatagagaactgtaaattacaaccacaaggatataccacattagaaagactgacaatacctaatgtccggaaggctgtggcacaaccataataactcccataccttgctagttggagtgtaaaatggtacaaccgctctggaaaactcagagcttctgaaaaagttcaaaatacagctactttttacttccaaactcgcaattcccctcctaagtatttctccaagaaacacgaaaacatatgatcacaaaaagaattgtacaagaatgtttatagcagctttatttcataaccgcaaatgggaaacaactcaaaaggccatcaaaaggacggatatacaatcgatggactatactaaatgaaaaggagcaaaatactgatatatacaacatgaacgaatgtcagacagtacattgaaggacagaagcccgacaaaaatgagcacataatgtatgattccccccttttttttgagacggagtttcgttcttgtcgcccaggctggagtgtagtggcacgatcttggctcactgcaacctctgcctcccgggttcaagcgattctcctgcctcaccctcccgaatagctgggattacaggcacccaccacgcccagctaatttttgtattttttagtagagacggggattcaccacgttggccacgctggtctggaactcctatcctcaagtaatccgcccgcctcggcctcccaaagtgcaggcgtgagccacagcgcccagcctgattccattctatatgaagttctccaacaggcaaaatggttatggagatcaaaataaaggtggggtcgggaatcgactgggaagagacgtgatgaaacgtttctgggacgatgaaaagggtctgtgacttggtaggcatcacggagcggttaggggccaaaactcatcttcctgtgcacttgctgtgtgcactggcgctgtgtgtaaatgccacctcgatttaggaaaaagatgacgtaagtacggcacaaagtggccggtacgcggcaggtgcatgggaagaaactgcggaatgaaacaaccgcgagctaagagatggggcagcgggagaaatgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacaggtagattgtttttccgacaaattatcaaacgacccatcattgcactctttcaaaatttgattctcagacgtacccattctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatc

SEQ ID NO: 196 - DNA, 107446 bp, Homo Sapiens
tcatcattaaatatttattgagtgcttactgtatgcaaggcactggggatacaaagaggtataattcatggctctgcccttaaggagctcacaatctagttggaaaaacaagacatatatatatatatacatacaaaaatcagtaacaacacagaggcctgaacaattgccaagtggacaacagtacagataataaagaagcaagaaacgagggttcactaaaggctatagtggggaagggagtgcttcactgagagagtgggacttgaactggtattaaaaacaagagcatcccgggcaaagggaacaacactcacagctcagaggcaggaagacactctgcgggtctaagaaatgaagagttaaatgtggctagattggaggtttggtgcagggctaagagagtaatactcgcttagccaggaaaggatgcatttgttttacgcattttgtgcgtctgaggggctggcaggccttgcacgtggcagtgtctatcctgtcagatttgggaggtcagctattaattagatcagctattaatcagactgttctcctaacactttaacttcatggatgtaccttccttcctttcctaatgccaactctgtttcccgggtaggtgtttcactgcctgaatgaaatcctagatctctgtcacagtttttgttcgctggtcagtcagaacctaggcccactggatgagcgtggagccgcccagctgagcattctcgtgaaggtgcgtctgcctggaagtatgcagccttgccgaaaggacagaggtggttttgccaatggagaattcatgatctttcctctgagtcagtaaagcatttcctcaatacacacacgtacagagataagatacaaagataaaaatgttggtatcagttgattttgaagcaggtaatactgtgccacctcacagtgctcaaaaatagttcagtcctgaatagtttattcagcccatcaaataagcattgggttgttctaacttcctcacatcctcccccctccttacttccttgaactaacccccatctcactgagataattatctgcttgtaatcaaaacgggttctccccaaccccagtacttgacaaaatacattaactggaaaccagctactaaattcctactgatgaaagagtactttcataggaagtcatgcatgtatggatttggtacaagtcattttaggaactaatagaaataggaatgtgggaaggccaggtggttctgtagaattttgaacaaggcttttccaagaaactcctccctccgcccccatcctccatatggagagttggtgagctgaagtggaatgacagctgagtccttctctctgcagggctttagccgccagtcttcactcctgttcaagattctctccagtgttcggaatcatcagatcaactcagatttggctcaactactgttacgactagattataacaaatactatacccaggctggtggaactctgggcaggtaggagcaacccttgggtaactcagtagactttttaaggtggctttttaatgagttgtagaattctagaactggaagaagactttagtccaaataccctcattttataagtaaggcttagagatagaggtgtgaccatctttaataattttaatggaggttattttctagtagaagtcatcatcatcataaaatactaaaaaacctgacagtgagataggtgttaagtcctttgctaggttatgtattgctatgctgggaggcagtgggccttccactcccaattctgatatgaactagctgtgcagccgtgggcaccccgccttgctggtccctagcttccgcatctgtgaaaggaggcgaccaccccttctaactctaaactttaaaaaaaactgataccgagattcagtggtagctggcttcccagaggtctgtcattcccattcagaaaatcacttcattgtcctttctctctaaaatgtctgcaagcagatttttttctaagctattgtagcagaagagtcaaaagaaactcttcagttttaagatgacattatttagatcacaggttatcctgattcatatttctttgaaggtagtcttgggaaagcatgacacttaataaggctctttttctcttttgtagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttctactgctgtctctggagcaggagctggcaaactatggcctgctgtctgtttttgtacagttttactgaaacacagccatgcccatttgtttactcattgtctatggttgctttcatgccctcacagcaaaggcgagtagttgtgatggatcaaatggcccacaaagcctgaaatatttactctttgaccctttacagaaaaaaaccttgttgacccctgctttagagaatgagaagccatgcagggatcagtgatgccagaggaagggaaggaactgcttccagctattgtgacaataataataataataatattgggtctttgactagaacgtgtaacatttccaggtgttctcacttgtgcttcccatgtttatcttacggaaggtcattccatcaagcttatggtcactgtcccttcatggcagttggtcctttcgttctccctttagctctaagagttggggagtacccacaggtgagctgtgatctcagctcagagagagagcatgaggtcttttttaactgtcaggaaacagagctgtgcccaattccactcaacttttggcacaactgttaatctgggccttcacctaccttaaactgagtttctgcaagcatagcattttagacaccctggaataaccttttgggaatgatgccacagaataaagttcactcttaacttttcaatttccttggccagctgtcctccgtaagtgaataagcctgttgaaagactcagagaaagtactatgtcttgtcatttgttctgagattaagctcaaaaaaacagatgaagaaatcccagttactacaaccaaagagattcaacatttattttatcataaaagttcagcaaataaaactatatacaagatccatgcaaggaatccagttacacacaagacacatttaaaacctggttaaaacacaatctccacgatagcagggaataaaaccagtaagaccaagtatctttagtgagaaacataatcgtgtttatattttggatgctgcttgaatccaattctctccccaacaatgaggcactggatcacccactcttgtgacaccacaggcagctgcaatgcttcagcacacttcagcaccgaggctgggcatgaggggtccgtcaccaccacatcaaatacccctaaagcaatatctgcaaggagcaagggaaagtgaagaaggaaaggacactcaacttagccctccattagaaagagagatttgattctaaccaatacatcccactctgcacaaaccaaagccctattatgtcaaacacactgctactgatcatgaccaaaggcagagttataatcactatgtgctgaccttgtagaaatatttaacaaatatacgtccagtgcttcacttatgttgactcacctcttgaaggtggtacttttcttctctaagaaacatggatacggtcaacctattaggcctgagccttggaccacaaggcctaacacctacaggtctaaggagatccctggaacaaagacactacacacactctttcaggtacctttgttatgggcacttgaatggtgctgcttcacagaggctgcaccaccagtcatgaggatctcagaccagagctccaggaagttctgctgttggtctgataccaagagtaccttcagattctggaaaggattttcacggggttgcctatgaaggagacaggaaaggaccttagcatgacaagtaatatccaacaaactgcctttctgcaaagggactcatgtacatctgaatgctttcaaaaataaatgccccatcagacatagtgtctcaagcctgtaatcccagcactttgggaggctgtcgtggttggatctcttgggcctgggagttcgagaccagcctgggcaatgtggtgagaccccatctctacaaaagacaacaaaaaaattagctgggtgtggtggcgagtgcctgtagtcccagcagcttgggaggctgaggtagggggatcacttcagcctgggaggttgaggctgcagtaagtcgtcactgcgccactgtactccagcctaggtgacagagcaagacttcatcttaaaaaactaagccctatattagggtcccccttctcttccttctttctatgaatgatctgtattccttgcattcctggctttctaatttccatgtttgttctggggctgagaataatccaaatcatgctcctgagcctatatatttttaatgcttgcttaaaacttagttctctgactttacaggttgagaatattgaacctatatacaaatcttcacacatttgcaaaaggttcctagccaatgtaacctagggaaataaactagataaactcctgaagtcatttcaaacccactcaaatttatcccacagacattccaatttctagaaagctttactctctcacctagattctcttccctccaaagcttgctgtcctcctgcctatacaattctggatgggcttcaaatacttaccagtccagaattctttgctcctcaaggctgtacccagctggcaacagataattacggtagttctggagctggttggcatggcaactatcatggacccagacatgagacacacaaggaatcccactggcaaggcacaggaagtacttccgggttcgacaatgctgatccgcaattagaagacactggtaagctgtgttacactgcaagaaaagaagcagagccaatgggtttggtgacttctgtggaaagctcctaagcagcagccataatgagccatgaagagcagatctgaagactcccaactactacccaaaatgtgatttagtctatcctgcccaaggccactcttctcactggaaggcccaagtaatttccatagatgttctctctgcctcacctgcagcatactgaggacctaaatcctcaacggacaaccaaaacctatgaactcagcctttcaggctaaaaatcagcaaccctaataggggtttctactactaaacataaacatcaatcttcttttgtcccagcaacagaaccatagccattaactaacccaaggtcctaccttctcttccctatacacaacaaaaattctatttcatgcaaaaacattttggcagtttctcagttcctgaaatctctggctactttatccaggttccccaacccctcccaggcctcttctcaacacagcaagttggctcttatcattgccactatattaggttacacaaagaaactcctcacctgggcttcattgaaatcttcaaggatatagccagctcctgctcgaagctgggattctgtatactgcttgttgaaaggaggaatttccaaaaattctatattaaaaaaaaaaaccaagataataattactgagtggttttcttatttgctaccttatgcctccttcttactgcccccttttccactccccagctatccacaacagtgtgtccccaaagacaggccaagggcttccccatgggtcagaaagagatcttgaggcctttaaaatgctgccaaaagaagggacaagagtaggagggaatgggaagatgaggactggaggtaggtcctagacctaaaaacatcaaaggttcctgcaccggaccgttgatagggatgggaacacaatcatttcccacagtgacatattccaacttgaataacccttaccatcaggaagttccctttgtgtctatcctaaatctttcctgttgaaaactaaaccccatttcctctagttctgccttctgtggagatgaatagctgatgaacactttataagttatatatgaagggtttattataaaccactgcatcagcctttttacccccttgtacaactaaaactttaataaaccagaatgctcaatgaaatatggttttaaaattttaactgattaagtgaaggttagaaaatcctgtttcaacctttttattgaaaactatctacctttgatgatcttgaagtacctcaggacactgaacaccaatgactgctctatagtcttgagagtgaagtagaagatatgagagatgaggctgaagctgtaatgaccctaggcaattagaaattgcttcttttgaccaaatatctaatttgagcttgttttcttgtcatctgctcctctcatatataaataacacattaaaaaaaaaaagaaaagaaaagcaagacattagagattttagttaattaggagttttgggaaattaagttctaattaactgaaatttttatcacaaattttaaaacccaacccaatccagtgcataaggttcaatgccggtaccactccccttccccttcacacccagtagtaaaacttagagcagatcccttatgacggctcccccttcagtgccctcgttgtctgctggaggagctcaggcaccgccgaggccccaggtcaggggtctccatctccacttagttctgactagccaacctattcacttttactgctcttttcttgattcagcattctccacattcttctcaaattgaaatcccaaaacagaaactctaaatggttataagaaactcagaatacagcagggctatttctcagctttgtcatagcacccttttgctatctcaatatagcatgtcacaatcttcagcaccaagattctactgctgagtcactgccaacaccccttacagtcctgtatttttctcaagacttctactttatgtctgcttaatccaggactggtctacttagattttaatccctaattatatttccttaatttgtctaatgaagtattaccctgtctaggcagtgtgtttctctaatttttctcaaatagtctgggttccaatttcttcatttttgaggtataagtgccctgcccagccagatgctaaaatgaataggttgttaatcgtgccatctaaatcaagtatgaaggtactaaataaacccaactccagggtcaatccctgtgtctgaaggatctctgatggtgtgccacccaacaagattaggtaccaaacttattaataaatatatctcataagatgaatttaaatattttactgagctcctgttgtaagctggtgtctaagaattcctatttatctgtaacatctaccaaacagtttcttaaaaactataattctgtagaggattgttttagtattagatgtcttccgccttcttgagattgagaaacccccaagcattctcatacactgaaaatatcaaggattctggtactgttgggctgcgcccaaggatgaaggcaccaacataaagacacattcaccataaccacactgtctatcagaaacctgaagatcccttcaaaaacactgtccaaatgcctcattttatttttatgagtacagttttattacatctcacgcaggcacacggattttaatgaaactggacagcctgcatctcataccagtcagctttcttgactatgctgaaccaagcaacaaacaaaacatctatacagctgccttgtgaagtcctggtttcaagtccagcaatattgtaaaagggggaaaaaaaaacccatgaccatgaccactgttttaatgccatgacacacctctatgcagaatcctcaaaagactcccaattttcctgtccaggaaactcttcaaataccttattcccactgtgcctatctgattgtttgacaagctaggtgttgcaaacactggaccttgaaatcccaccacaccacatctactcactcccacagcccaactctcccaaaccaaagcctgcccctgatcatcccttccatgtccttgtacatatctacacatggctgcagtcggtgagatatagttttggttaattaggaaagagtcatccacacacctgaaatgccaaccctcacagatgtccagtggtgcaaattatgacaaccatgttgcctaattcaattccctcttgcaagacaacattagtcagaactctaacttgtacaacatcattccatctggacctttagcctttacagacacattcagatactgctgtcagtcacatttacagtgtatacatttatatctgctcattccctctcctagatcactcatttttcagacctctacccactgcagccttccttcaaaaactaacagacaacacagaaataaatgcaatgtacagatttaatttaaggttaaagagaggtataagagttgaaaaggcctagaagctgtttctttgcaatcaccctgaggaaccaggcaccccacagtcccagtcttagacctcaggagaatgaaccttaccctccacatgggtttgctctagcagatgcccatagaacgcaaatggggaagatggcagggcattcagacctgattgacttggatggttgcagtaggctaaaatgacagagctctagtcacaggtttgtcattattgtggacaaaaaaaacacaattatttaacctttaacctctccaaacttgtttcctcatccataaaatagataagatctatctcccatctgcctcacaggattgttttcaggaaccactcactgagaggaattttgtgaaaacagtctagaaactgttaaaaagcaggatacagagtaatttctgtgaccaagatcccagttgctacttgccttgcctcctctacatacaacagggggaccaccagctcataagtgactggaaaagaaagaagtgcctatgtgtcagagctcccagggcttcctaaggccttaccctcctcttcttcactgcttcctgtaggaccatctggcagtttggagcggctggccaacttgtcactggttgtggccatggtaaggagaaatgcgtagcccagaaacaaggtcttgttgagaggcaaaggccctctctgctcttccagggcagagggttcaccggtgttgtctccactctcacaggggctcacaaactctcctgcccctactgcacctgggaaggacaggggcacagttactagagggatacacaccattgcctcagcaaaagccttaacaccaaaaggccccagcaccaagcatgacctgatgggcaggcactgtcctgatgaacttatctgagccagaaaccaaagaccattccaatggccaaccattctaaatggccgacagcctaggataaaatttacaacaaagagaaatttacatatttaaattttacacagtcatgataatgtatacagtgttttcataaatgaaaattaaccaagtattgttttcatatagccacaccaaatacttctgaggtcatctgaagaaagaggtggttctaatacaaagaaatagtaggtgagagtgaaaaatgtttggaaatcttcagcccactttctctgtcccgtgctctgatttcccccagggtatgagatattttgaagcagcctttggaaaaaaaaaaaaacccaacacttttttattatcaagaaatgccccttgtagatagatcctcccaccccatcactgaccgtcaccagaatggtgcagagaatacttggtaataaagtgtttttacacatagatggtgccacatcaaaatagcctgcctcaactgaattagttttcaacacctgggtaagtaagtgaaccagccagccagaacacccatgccaagagtgcccccaataagtccttgagaaaaaaaacagatacctgacctggagaagctgaatcgtaggttcattaggaggctaagatgacagacaggtcatgcatgcctccctaaaataaaaccaggagcaagaaaacagtctcagaggcaatatgacgttatatgaacgaggctggaattagaagtgaagaccaccaaagtttgaatcctggcttactttgtcatcttgggaaagttagccaacttttctgtgcctcaaagtcttcaactggaaaactccttctagcacctatacttcataaggattgtatgtgaggtattatgtgtgaagtactgagtgctatgcctcatacagtaaatattcaatgaactattgtttttaaataccctgaaacacagcagcagttgggtagataaggagatgacacaattcaaatacataggaaacaaaagaagctctggtgccaggacaatgtaacaatcaatggagtttcatcagtttgctagcctgagaaagttccaaaagggaatagactgattttacctctgtaatctcctgaacccatagcagctgggcctgggtcacagtagggactcaatgaacaacagatggaatgaactcctttcttaattattgaatgctagggactggaaaggggttgtttcggggataatggggagagggaagagcatactgaaatatgactttttttttttttgatggagtctcactctgtcacccaggatggagtgccgtggcgtgatctcggctcactgcaacctctgcctcccaggttcaaatgattctactgcctcagcctccggagaagctgggactacaggcatgtgccaccactcatagctactttttttgtatttttagtagagatggggttttgccaggttggccaggctggtcttgaactcctgacctcaagtgatcccccaacctcggcctcccaaagtgctgggactacaggtgtgagccaccatgcccagccatgtttcaataggaagtctgagaaagctagagggcctaagcacaagagagaggggagcagaatttccaggaagaagatggtgcaggcaaagagaaattacacctattttgaatctgcttacatttcaatacttctcctttccctcctagaacccacacagtagtcaaagaatggtgtgatcaagtcctggccttctttttttttttttttttttctggagaccaagtttcactcttgttgcccaggctggagtgcaatggtgcaatttcggctcactgcaacctccgccttcctgggttcaagcgattctcccacctcagcctccccagtagctggtattacaggcgcccgccaccacactcagctaattctggccttgctatctacccgcactagagtctgtaggggatgggggaggagggatacagtgagctgtccctgaatatcacctgtgggcttgggcaggaccccgactttatagcaggacagaagggccactgccacatattaagctccatttttccagcagctgaccctgcattctgccatggtctgaaggaagaatgaggcaaaaaggagcacttaccaggttttactgtggcagacttgcgacctcgcttggcaggggaccgttcctcttcagaagtgataagttttcttttgcctgagagaactcccatggaggcacgaggactttctgtgatctttcgggtaggggttgtgctgctgctactggaggcagtaggggtggctggggagctgacgttactgcgccgtttccgcttcccttccaccaaattgtctatggcaggataagccaaacaggttggtcaaactctatggtatgaggccctgaactccaagaaactgggcagaccctgattcagacaccacagtgttccttcccccacttcccatgaggccaagaagcttctttttaaggccatattttttatctagtctttgccatgactgaaatgtgtttagtcccctatagaactgaggaggccagaaaaaccctaaggactttctgtttggtactaagaaggaaacaggtaaggcagcagctctagaaaatgacagctcatccaccatctgagaagccacacataggaataataaaagttagggaaacattactgacaggtccagaatctcctcccactgtaagcagaacaggagcccaaaagcagctgttcaggaagcaaaagtcttacctaagctgatatctgctgcctttgtaagaggtgttactgcttcataggggccaagcccatactgctctctcagtctgtttccttgctccaaggacaggatgacagccattcgcttataccactttctttggccttctttttcaatgctgtagtacagttccccagactccttcctatgtcctttcaccactcctggggggtggaaagcataaaagaagcttgctgttgtcttaggctccttagcaccctctcacaagggctctgtaaagcaggcctgagttagggaatttagagatccaacagtggactgaagttaggacttaacaaaattccagttgtcaatcccaaacagtaacacttaggatatatgtagctactacactgggattaggacaaggaaagtttcttgacagaaggtagcctttagttataaaataaagcttcccaaagacagccattgtggattgctggtggttcaaatgatttccgtgaagtgaaatggcatgtggtttcctaacaattccattataacttctaaacatttccttcttggttccctgggaggctgagtagtaagtcttgagttaagctgtaggtgaaaaatgacatcattctaagagagacagcatgtgtgtgttttctctctgtgtgtgtagcaaaattagagagcaaagaaaggaaaaaacagatcctgcctctcctacctaatcttcctctctattatctactttcctgctctgattcaaaacctgataaggcctttatgttaaaaggaacaaaatgtgggatgtaaaaggaaactaagctataattcaggagaactgagcctaggcctaattctgctgccaccaagctgtgtgatcttgggcaggacccattactaagcctgtgaaaaagaacacttcttcctatcaatgaataaacaatttacaacacacacacatactatagctatagatacacacccccccacccccacacacatatacaatacaaaaacaaggcattactatgaatattttttcattcctataaacagaagggtccaatttcttctcacccattagcctatgcttgaatgaagagctaaaagaaacccagagcctaccccacccaaggaaaataacacagagaaagcaagccttggttctctatctatcctgtggaatcactcccttttcccttacttgttcatctcctagcttaaatctctatccccaaactaagtcacaaagactccctcaaaaacacaaagaagcccaaggccaacaatatacttcacactaatgaagagctactagaactagaagtagtctagtgttgacatgagcaaacagcctcaagaaatgggacacagaatccccacaccttgatgccacagttcactcttgttacagaactccgtctttaaaaggccaaatatgaacccctaagagtagctttacacctgaaagaagaacgaatgcatttgatacatacaaactatgagtcacaataaaagaccccaatccatgtgctactcccaactgatcccatatatagctaacaatgttatccagaactagaaggtgaagtggcccatttaataatgaacaaagggcaaacaacaattactcagaggattccaaatacaagagaagcctggatggactccaacagaaagccatttttccagccgggagcagtggctcactactgtaatcccagcactttgggaggctggggcgggtggatggcttgaggtcaggaattcaagaccagcctgaccaagatggcaaagccctgtctctactaaaaatacaaagattaaccaggtgttgtggcatgcacctgtaatcccagctacttgggaggctgaggcaagagaatcacttgaacaccagaggcggaggttgcagtgagccaagatcgtgccattgcactccagcctgggcgacagagcaaggctctgtttttaaaaaaaaaaaaaaaaaaaaaaaaatccattttttggctgggcatggtggctcacgtctgtaatcccagcactttgggaggctgaggcaggcagataagttgaggttgggagttcgagaccagcctggccaatgtggcgaaaccccatctctacgaaaaacacaaaaaaaaattagccaggtgtggtggtgcgtgcctgtaaacccagctactcgggaggctgaggcacgagaaacacttgaacccaggaggcagaggttgcagtgagccaagatcacgccactcactgcactccagtctaggaggcagagtgaaactgtgtctcaaaaaaaaaaaaaaagatagaaagaaagccattttcccccattatatgccaatccatgttcaaaaagtcctcagaaagatgtttttaaatgacaaactcaacacaaataggtatcttcaaattatttccatagaaaggagacaatatattcaaagaactagcacatgaaacaataacaacaagcataaccacaagcataaacctctcactatcaccaatattacctacttcaaaaataaaaaggcactgttcttcaaaccagagaataagtggtagatgtgcagtcatacagacacagcactaaaaacttctccctaagcaaaaatatctcaatatcacctactgggttccaatcaaagcaggtagctaagctttaaaaaagaagagagtatggaaagggaaaaacactaactttagagaaggccacctgtccctctcttgcagtggctcacgcctgcaaacccagcattttgggaggccaaggcaggtagatcacctgagctcaggagtttgagaccagcctggccaatatggcgaaatgccatccccactaaaaatacaaaaattagccgggtctggtggggcacacctgtaatcctagctactcaggagactgaggcaggagactcacttgtacccggaagctagaggttgcagtgagcctagattgcgccactgcactctagcctgggaaacagagtgagtgagactgtttcaaaaaaaagtgaagaaatctggcaaatacaaccttaaccagtgatgaagattaacatcctgcatcagtgatgtcatgtggatacatcacaaaccttcccaggtccttatatgataacatgagaagggcatttcacctctgtggcatatttttttttaagagacagggtctcactgtttcccaggctggagtgcagtgtcatgatcatagctcactgtggactcaaactcctgagcttaagcaatccgcctgcctcatcctcctgagtagctacgacaacaagcatgtgcccccatgcccagctaatttatgttccttttttttttttttttttttttttttttgagagacagggtctcactatgtttcagcctggtctcaaactcctgacctcaagtgatccccctgctttggcctcccaaagtgctggaattacaggcatgagctaccacacccacccatctatgtggcattatttttaaaatatcccataactccagtctaatgagaaaatattagacaaatccaaatggagggacattccacaaaatacctgaccaggactccccaaaactgtcaaggtcatgaaaaacaaaagactgagaaattgccacaaatcagagcagaccaaagggtatgtgatgactaaatgcaatgttggatgctggaagagaaaaaggacatgatggaaaagctagtgaaatccaaataaagtctaaagttttgtgaatagtaatacaccaaggttggatttttagttttgacaaacgtcccatactaacaccagatgtcaacaatagggaaagctggatgaggggtatacaggaactctctgtactagcagtactttgtacttcgcaaattttctgtaaatcatctaaaatattccaaaataagtttattcaaaaacaaatgaacaaacagaaaagtcagtggcaagagtaaccaattttgtaggaatgaaatttctgactttagagacactggaaaagtaccaagtaatgtcttggtaactactaacataacagagtattattgccccaaggcacaaaaaaatctctacaaactctgcttctttcattacctgcactgaaatactcatcctccgagagggccgtcacttcagtgtccagcgggatggggtcacataacagaatgtctttgcccaacacatcacattcgtacccatcatcaaagagcaatttatacttcccagctccgacatctcgtgtgattttcccagagtaaaagtagccattggatgaccacttggctacaacacggagccctacaaagctatttcctggagaggaggcatctaagccatcagaagggccagcagcagcctggaaaggaatttctggagagtcactacgacgcaaagcaccagcacccacatctgttcgtctggtggagtctggcactcggggcacgacacggctgaaggatttatcatctggtgacaagttaggtgaaatgtcctctatgcccaaggggccaggcacagctgtttctctaaagagagataggggataggagaagccggtgagaacaagaacacagaagtatatatctaccaatttttccactcctttgtccatgggtctcctcagcccattctttaaaaaccccatcacaggcatgagcctggtctctctgtggcctcactctgatccctgcccactccccagtcagtatggcccctcttctccctcctgacaccccacaaactctctactcccctctcctccattcccttgttttctgaacaacagactaagtatatcttacactacccaggtacctggttccagtggtccgagaaggtgggcggccccttcgcccacgcccacgaggcgtgactggagccttccctccctgtctgatgccaaggcctgcatcaccatcctcctcacacactggcgtccctgtctgactgaccccttttctaggactagagaatgaagacaagttagtctgatagcacctgctactgaatcttttcttcacaaagtctccccttggccctcagactacatgacaggcctacatgtgctgagcctttggggcagcaggaagctggttcacacacccaccaccaaaatctcatgcagggagtggggagcgtgggataacaagtaaaggacattctccttcatgtaagtctattccctctgacaaagcttcctactgctgctgcaaaaacagcacacccaatttctgctatgccttctcctctactttaggctctggacacctgcaaagaataacaaaaagctaggagatgcattaagtttgggctactatcccaaacttcctgtactcccaactaaatcatataaaggctgtggtagaagcagtgcccaccagatgataaattcccgaaagtcccctcccctgttacctacattttctcaggggctgctttgccaatgaagtctacctgccacagggctccaccctacttcccacacaaacccaaaacaggaagagagcaaatagtgaagaggggtagttgatttatctttaatggaggatgggggatttcccattactccccttttcctgtgatattaaaatgtcagcaaccctgcccctgctgtggctctctctctctggagaccctgtctgcacctcagttttcctgggcctcctcgggagctgggtaaggcaaaatctgcgggttctgtcccgctggttttccctctgagtggtccggctcctttccctgagcttccactgctgtgcatagctgagagacttgtcccacttgatgtgcggtgtaagctggatgccttggaggagaaggagctgatatcccccaggtcacctgaggagcccccagtctgtgaaggggaaacttcagtttcacactcctgacactctacaattggctcttcagtctcctgcaaggaaaaaatagatacagaagataaaagatgccataataacacaatgctaatatgatggttggaaaatcctacagatggcacaaaattataattcaaaaaggtgagaatcaggagactttctggaataatgggaatgttctgtatctgttttgagtagtggttagataaaattttcaaaagccactgaactgaacatttaggatctgttcttttttttttctcccccaggtgattctgagaagaattgttcattctaatgggactatactgtatctcaataaaatataaaataaacatggtactatattggtaagaaagagtttatctttttattggataagttcacaacctctggctaccagcaaagattctaacctagacgacagaagtaaattcttatctgagagaagacagggaaggaggtaggcaggtgagaggagaaaatgagtggtcaggagcccttctaggtacttcattaacagtggacagcattacatgttttgacattggttattttacattacctttcaataactgatcaaggcaatagaaaagtatatgcaaaaataggctaaaaggggtcaggtgtggtggctcacgcctgtaatcccagcactttgggaggccaaggcagaaggactgcttgagtccaggagcttgagaccaccttaggcaacatagtgagaacaggtctccatatgaaaataaaactattagccaggcgtgggagtgcacacctgtagtcccagctacttgggaggctgaggtgggaggatcacttgagcttggaagtcaaggctgcagtgagccgggatcatgccactgtactccagcctaggtaatagcatgagaccctgtctcaacaacaacaacaacaaaaaaggctaaaatagtattaccatttggaaaaatgaaggacaaaaaggttataagtatctatagactacaagaaagtcaaactggctttatctcggatgcctactttgataaattggtagtagctgcctggtgctcagttttaagaagccttctggaggctaaatcccagacttagtgggaaaagattctaagaccaatcagcaatgttcgctatgggcacagcatagagaaattatagcatgagtatgacacatctgccttcctagtctagaatgttcacgcaatattatgttaattgccagagaggatatggagatgtataagatagatccttccctcaaagagtttagaattccttttgggaggccaggcatggtggctcacgcctgtaatcccagcactttgggaggcagaggcaggtggatcacttgaggtcaggagttcaagaccagtctggccatcatggtgaaaccccgtctctactaacacaaaaaaaatagccgggcatggtggtgcactcctgtactcccaggtactcgaaaagctgaggcagaagaatcacatgtgaacctgggagatggagctgcagtgagctaagattgtgccactgcactccagcctggacaacagagtgagactccacctcaaaaaaaaaaaaaaatccccatggggagactgtatataatgacacacatacatatacatttagataatactataaaatgatgaaataattatctctgatccctcccttcttgaaaatctctcctcctttaaaatccataaaagtacttttctctttctttcagtctacctttttggctacttctatttatgcttctttgggttcctctttctctgtgtgttcctttaaaatcggtatttcccaggactctgtttttattccttttctcactctcacatgctttccctggtcagtctcaccacactcatccttacctcgctaccaagaatacaatgatgactcagcttatacaaatttctactagtcttccccttggatttaccacaaacacctgaaattcaacagatccaaaacaatctgtgatcttccctccatttctctgccttcaatgaataaatcctagatatccccagtgcatctcacatctcctacagctctttctagcagagactggtttctttcagccgaacctccattcaagaattttgagatgagatacctccttgctccccactgccatttacagaccatttctatttccccacctcctctccttcaaaaccactatttgccactttcttaaaactatcttcaccccttccctagttgttatccactaacattctccaaatcaccctctctcatgcatgaagaccttagcttcataacctctctaccttccccattcctacttctgtcatcattctcagtggcctattttaactagatacacttgtgttttcacatctgcaaaatgagaataataactggatctatcacagaatagttgttaagaattaaataattcactaaagtgcttagaataatgcctggcacatagtatgtgctcaataaacgctagtcactatcattatttaagtttagtagtgcttcccaaactatcttccatagggaaaaaacaggtattactttaaaaaatgctaatggtcatgtaagtttgggaagtgctgggttaaacagaataaaataggtatccttactagaggacttcttagaacttttaatatggtaatatgtgaattttcatgttagtggggacagggattaatggcgtgctatggtttgaacgtctgcccctccaaaacacatgttgaaatttaatacccaatgtaacagtaccaagaagtaagacctttaagaggtgattgagtcataagggctctgccctcatgaatggattagttcattcatggattaacggaattacgagctaacagattaatgagttatcacaggagtgggttagttatcaccagagtgggtctgttataaaaactaatttggttctcttttgtaaggcccctggcaatgtgataccctgtgttgcctcgggactcttcagagtcccctccagcaagaaggccctcaccagatgtagccccttgaccttggacttcccagcctcctagactaagaaataaatttcttttatttataaattatccagtctcaggtgtttaaatatagcaacagaaaacagactaagagagcgtttcatgtttctcaggaccatggaaccttttccctccatcaaactgtctaagaggcctgctgtttccagaaatatactttagaaagcaccatataaaatactaaatgggcctagcagcacagtagctcatgcctgtaatcccattgccttgggaggccaaggcaggaagatcacttgagaacagagttcaagaccagtctgggcaacacagtgaaaccccatctctacaaaagatacaaaaattagcagatgtggtagcgtgtgcctatggtcccagctactcagaaggctgaggtgggaggctcccttgagccaggaggtcaaggctgcagtgagctgtgatcataccactgcactccagcctgggcaaaagagcgagaccctgtctccaaacataaaaataaaaaatatattttaagaaatgaagtaatgtgtttaacacttaatgtagtgtactaggcacagagtttaatgtggactacaacagttacaaaaattttcatgaaggcaaactgcttttcataatttctccaaaatagtaataacatgaaaaaagttccacgaacaaaaatctttttaaaacatttttaatcgggaggctgaggcaggcggatcacgaggtcaggagatcgagaccatcctggctaacacggtgaaaccctgtctctactaaaaatacaaaaaattagccgggcgcggtggcgggcacctgtagtcccagctacttgggaggctgaggcaggagaatggcgtgaacccaggaggcggagcttgcagtgagccgaggtagcgccactgcaccccagcctgggccaaagagcgagactccgtctcaaaaaaaaaaaaacaaaaaatatttttaaaatgaagataaagcagtattttaaaagaattatttctggtatttggtatacacaaagaataaaaaacaggccgggcgcagtggctcacgcctgtaatcccagcactttgggaggccaaggcagatcacttgagatcaggagtttgagaccagcctggccaacatggtgaaatcccatctctactacaaacacaaaaattagctgggcatggtggcacacacctataatcccagctactcaggaggctgaggcaggagaatcgcttgaacccaggagacagaggctccagaaggccaagatcaggccactgcactccaacctgggcaacagagtgagactctgtgtcaaaaaaaaaaaaaaaaaaaaaggaataaaaaacaattactcaatgagtgtctgtaaaaccaatgaaatctgaataatctgtggatagtaaaacaaacaacaattcctcaaactaacatcaaatgttatctgacatgagggccacaatagcccactgaaaaatagtaataatatgttctatttaataaaactatacactagagtttaactctccctgagtacaacctcctacacggccagcagatagaattaaaggaaagtatctgggtaaaggaagaaaacagttgtgccttgccgggcgcggtggctcacacctccaatcccagcactttgggaggccgaggcctgagcacaaggtcaggagttcaagaccagcctggccaagatggtgaaaccccgtctctactagaaatacaaaaaaaaaaaaaaattagccaggcacggtggcgggtgcctgcaatcccagcgacttgggaggccgagccaggaaaatcacttgaaccaggaaggcggaggttgcagtgagctgagattgcaccactgcactctagcctgggcaacagagcaagactctgcctcaaaaaaaaaaaaaaaaaaagaaaatagctgtgcctcttaccaaccaataaaatggttcccagatcttaacatataccaacaaaggtcccagatctttaattctagaaaatctgtctaatctctctcattattagatgtaaacaaagtcagcatagtatgccattcaagataacaaacagtcactaaatgccaatactgagctgacatttgtaatgagtctataatgaatcccactaaaaaataaaggtgcatttcttaccaacaggtctatgaccacacacagatagtgacaaataaagaacagaatgagtagacatgaaaatatgtgagaaaacacaggtagtttgaaacggagtgttctaaactccatttgagtttctaaggatttaaaataatacatacaatctttatacatgagagagatttatcagtctgttctttacagaaaaggaaagcatgatgggatgcattaaataactaaccaatggtcaaacagcaaacctatggctggggaaagctttagaaagcaggaagtctaacttctaaccctgttcttctatctctggtaataaaaagatgaagaaaaacaaagtgttgcacaggaaagcgggatggggtagaaagtcaagagaatttttctatagaaagaaatgtggggtcagggacaatagctcatgcctgtaatcccagcactttgggaggccaaagcagaaggatcacttaagcctaggagttcaagatcagcctgggcaacacagtgggaccttgtccatccaaaaaataaacaaaattagccaggcttggtggttcatgcctgtagaaccaactgcaagggaggctgaggcagaaggatcacttgagcctgggaggcagaggctgcagtgaaacaaaatcacgcaactgcattccagcctaggtaacaaagtaagaccctgtctccaaaaaaaaaaaaaaaagaaagaaagaaatttgccacacagactcagagtatgtattacctcagttacttttctttctacttctgttccatccacataatacacatctgtaatgacacgagtgacaagtgtgcgtacttcccggattgttctcatgtgacgatgtaagacatggccatgtggaggctgaggcatatcaaactcttcttctccctgtgacagaaaatacagaacataagcacaggtctcactgcaagctgtcaaaatcacaaatcttatgcttcatgatgagaactgtttagaggctccatgaatctagtgtgacagaatcttcctactgttttgttttatccacctataggtaagaccagggatggatgagttatatagccagaggctaagagaagtttatatgagcatgacctaataaaatgacctattcttgtctaaatcaaaatcattacatctagtacttgtatttacggacatttaggtgaacctttgacccctaaaagttcattatttttaaaccgtatttcttctaattctgatgctatcttgcaaattagtaaacgagtttacatttgcaatagctctttagataaaaggaaggcactctttagtcctttatataaaaccagaatgatgtatctgttaatctcagtttatctgtttttcctgtattaaagtgaaaaccacagtttattacctaaaacaatatacactgatctctcctagaattaaatataaaatatttcatctattccaaagaacagattatgactaaagagttgagctagtgtccagaaatggaaaaattagcaaattaagattttatatctagttctactacaagaataatgtagggctaaataagaccctactttttatgataactattaaataatattacttaggaggattgagcttctttcattcaaaaaacattaagcaaatatttatcgaataacttaagggtgccaggtactatactagacaaataactgctggaaaattcaggacaggtaaaactcattcaacactgaaaaaattcaaatgcactatttcttatttacaaaaatacaacaaactaataacaactactgctattcaaaagaataactgagttaactaacatagcatccagcttcattatttcttgttcataattttctatttacagacagcccgagttcatattttagtcagatctgaataatttttaaaagataacttcttagcaaattaggtcttaaagccctatttaccacctcgaatcattagttagtttgagactttcggcctttattacctaggacctgcctgtggctaaaaaaaagtgctagaatttcagtcctgcatttctgaaaaaatacatgttttctaataacaactatatcacattttttcacatctttatcctccctcctacaccccactaactccgtaattctgaagagaaaatgcacacttttgtctctcaccttatctcccctatggtaggctgattttactttcagcattcagtatcaaagtagccaagtctttaaaaagaattacatatacaaatgcaataatggtaattctgcatttttttcctgacatgtggtagtaatttaccaaaagctttcagtaatttctccgaataatccccactccaattccaacttggaaactggcagaggtgaaatatttactaaaatggagatatgtaaattatgtgactagttataaataatatcaaaggcatgaaacgctactcatccaattatttaaaatacttctacatacttctacacagacacaactctgtctaatgaatggttaaagcacaggtctgtcctacctcaatcatcagggtacccatgcatgagaactatgacagcctgtacttcctgcctgcacacacaatcagactattccgcactaaagagaaagtcagtctaaaaggtttcagtgctttacatattcctgaaatgcagccaagaagcttccctgtattcttccagttacaacagccatatgaatgatcacttcaagacagacacttaagcgtgtctgagagaataaggagaaaaggtaaagagggcagacagaaaactatgtttactcacttcaaatactcttctgaaaagaggtgtctgtaaaataaataaattgatgatcttaccaccattaagggaaggaaacaaaatgaaaataaaaccacactttcccttccacctggttccacgtcctttttgacatataaatgaaaatttcaggagtgtcaaagtaggctgcctatgcttttccactagcactagcctatgtcctatctacactgaaggggatttttaaaaagcaccgacacctggaaaacttgcatacagcctttctcatttgctaacctctcttcaaaagatggcacaccaatttcaatttctgttattctatacaccatctatatatttttactatggtaaaatctgcataacataaaatatatcattgtcttgaacacaatgctcatatcccatatgtgccacaggtgttcaataaataagaactgtattttatttttacaaaacaaacaacttggacaatcaaaatgagaggtatatcaataatgaagatttcctaagtagatcccaaatgaagataatctaccacagcaactgaaaaagcaatttgaccactacaatatctcctttatctgagggagatatgtgccaagacccccagtggatgcctgaaactgcagataatatcaaaccctatacactatgtttcttcctatacatacagacctataatgtttataaatcaggcacagaaagattaataactaataataagataaactataacaatatactgttcacaatttcatggatagatttgttcttaccacagattttagtaacttcagcatatgattttttttctttccttattaagaccttttaccttttcacttagaggaagcactttatgacttacttctctggcatattcagattgccggcatcactactctcaaactttggggtgagagtaaaacaagggttacttgaatgcaagcaatgcaataccatgagagttgatctgataaccaagacagctactaagtcattaacaggcagggagcatatatagcatatggatatgctagaaaaagggaggattcatatcctagccaggactaagagggacagcactttatcacattactcagaacagcacagtatttaaaccttagtatttctagaattttccatttagtatttctggactgcagctgaccatgggcaactaaaaccaccaagaaaaagaaaccactgataagcagagactactgtttactagtaacttccaaattttctctgccatagatcccactctgccactcaatgaaatgttgtgaacttctacgtatttgttaacacatacatttctacgacttcttttcatctactcaattttttttttaagagacaaggtctcactatgttgcccagtctagtctcaaactcctgggctcaagtaatcctcccacctgagcctccaaaagcgctgggatttcaggcatgtgccaccaggcacagccacctacttaatttttactagtaccgacacttccctactctattccctggaacctgatactcctccagcctcgttttcatcagccccaatccttttcttcacattagcttctagtctagcctctcttctgcagttcttggtcacctggggacttttccccatctctctctctattcctgttaccattctttctgtttcatatactgaaatacactattcttcgtgctgcttctttcccccttaccttctactctctgaattcctgagaaccatgatgaaatagacttaagggagagaaaattagatctgatggttagaaggcaagataaaaagtatggagaaggaaaagagtgaatgtagaagagtattacaggacccaggcagaatctctggctttcttctccagtaaagacctacctaaaaaactgtagcaatactacattttccctaaaagactatctaatggctatagctacccacaatttcactaccatatctgtatcttagaaaagttgtttttgtcttttaaccactgttctgtacaaaactgtcaagaattgtcattaggcagacatgccacaacttaaattctctgagaatcctgaaagttaaaaacaaggcctctgatgcaccctagtatgttctctcacctggctatggagcgactctgtatcatccccaggagcactgactggtttctcaccactccccctctcagtctgaactgtggcatcttgctttccaaagttctggtccactgtactggtcccctgctcacacacattctttatagtctgggttgctgctgaaacagtttctgggaccctcaaggaacactccatggtttggattcctatgttattttggctgggcctttcaatcaaggccttactaggattttccttattagtactccgtccttctttctggtcttctagcacatctgtcaccattgcctctccttgaggactggatggcccttgtatgaccatcttctgggaagcaggagaaacagggtccttgacaggactaatgggcttcataggctgttgactctgcctgattgtatggtcaccctccaatttttctttctcctcttctccttgagaacttggaaagtggagcaagttccccctgaaaatgcaacatataaagaagccatgtcaattaagcaagtgtatgtgtgaacgtgtgtgtgtgcgtgtgcatgtgtgtgtgtagtggcaaggggggagccatattttgacaatttgagaaatgtaaggaagggagaaagtcaggtagtcaagcattatcaccttgggaggcctctcattataatttcactcctgtaaaaaaaataatggtagatagaacaattccaccatgatgataaaagagtcataaaatttcttcccatcactagctatgaactctgaaacttgatgcaggaaaatgaagtaaacaaaaagatgtaaacccattactgaagtcatagacaatgaagggcaacttagggatctattttgaaaaaagatcaattaagtcaagatgtcttatctggccttatgatggttctaacattccttaactgattcctagcattctagatactgtttatccccacctgagcaatatttttaggaaagaaaatctgacttacaaaggataaagctgtaggtagattctagttttgtcagctatactgatatatctacaactaaacatttcagaatgaattggtttctcaaagacagttcttaagatacagcccattttttttcataagtcatcccatttgggtatcagtgattcgttcctttattccacaagcatttgctgaatgtctcctacaaaccacataccacgatttccgaagtgactaggagctttcttaaatatccctaacaattctccagaataaaaacgtccaggctaactccaagtcaacagaaatttgacattcatgtcttatctatctttatatttaaaacacctaactcacagcttaatataaaatagatgcttaatacatgtactttgaacagaagactgaatgttctctgaatcaattaattgcaaaatctactcagattaaatcaacataatgcagttttaggctccattacacgcacaatagccagaataaaaataaaaggaatccattctgaactgaccatgctaagaccacatctggaatatctgtttcagttctcggcatgacagtttacaaggcataaactgtagataaactcagaaggtaacatgaaggacgataaggggcctagaaactatgtcatatgttgatttaagtatgtggccagaaaaagagttagggctgtctcctatttgacagaagctcttatccttaggatctcagctttcctacgtagacagggtaaaggaagcaggaagtgctcttcagggattgctctgctctagatcttgaaggaaaaggaaaaaagaagtttctgaggtttctatattgtttagctcagcctaccagaacaggagctcaaagagggatttcaaatagagttctagccaagaagagcttagtataaatttggttgttatagtgtgtgtcctatctctcaggaacctcaactgaatgagaatatatggtccaatgaagaagaagtaagaacaagaccaccaggagacacctaccatgagtagcacttacctcttatgaggtttataaatgttcatatatgtaaaatattgagcatagcagatgctcaatcaatattagatgcataagacaatgcaattaaacagactcagttcaccttcaatatcaactaaatattcatatttaaatctttaagacatctaacataccaatggctgagcaagaaggaaaggattcaaaagccagaagagccaggactcgattttaggaattcaattattgttgtttcctatcctaaacaagcttataaattttatctcatgctacagactaaatgtctatgtcccctccaccccaagacttacattaaatcctaaccaccaaggtgatggtattaagaggcagagccctcatgaatagggttagtgcccttataaaagagacctcagagagctctcttgcccccaactgccatgtgagaacagctgtctacaaaccaggaagcaggccctcaccagacaccaaatctgccagtgctttgatctagaacttctcagcctccagaaatgagagaaataaattcttttgtttataagctatctagcctatggcagtttgttgcagcagcccaaagagactaagacacctcagaagctgtttattcaggttagaatacctgaattgaattttacttctacagcaatccaataaattgtaagaagtgccatacctctctccctctccattagttccagctatgcaattctactctggtcactatatgccagacttagaaactgatgctaagaaagtaaattttaggctgggcacagtggctcacaccagtaatcccagcactttgggaagccaagacgggtggatcacctgaggtgaggagttcgagacctgcctggccaacacggcaaaaccccgtctctactaaaaatacaaaaaaaatagccatgtgtggtggcatacacctgtagtcccagctacttgggaggctgaggcaggagaatccctcgaacctgggaggtggaggttgcagtgagccaagatcgccctactgcacttccagcctgggtgacacacagaccaagaccccatctcaaaaaaaaaaaaaaaaaaaaaaaaatccaaattgaaatagggaagaatacatctccatatttaacaaatgtctaactattctattctgagtgtagctctgtttatgaggcatctagaatcaaatccagctagattcccagatctttgctccaccaaggttaaacaatataaccaacatcttggcacctctattttaaaacgctttaataaaaaagcaaggcaatacaatgacatcaataaatttagtaatagctgggtcattactacaccactgttaaaatcacatgatttcaggatcatctgattcccaagaatatcaacaagctcacacttattcagaatgcccatttaatgcactgacatatttattttaaatatttctttcaataatgagcatagaaatttagaaattatgctacctattaatttttttttttttaatggataagacataactctcactctctcgccaggctgtagtgcagtggcaccatcttggctcactgcaacctcctcctccagggttcaagtgattctcatgccttagcctccagagtagctgagactacaagcgtggacgaccctgcctggctaatttttgtatttttagtagagacagcgttttaccatgttggccaggctggtcactaactcctggcctcaagtggtcacccctcctcagcctctcaaagtgctgggattacaggtgtgagccaccccatccagtctttttttttttctttagacagagtctggctttgtcgcccaggctggagtacagtggcacaatctcggctcactataacctccacctcctgggctcgagccattctcccacctcagcatcccaagtagctgggactacagggatgcaccaccacacctggctaattttgtactttttgtagagacgaagtttcaccatgatgcccaggctggtctccaactccagagctcaggccatccacccacctcggtctaccaaagtgccaccgcgcctggctaaatcatgctacttatatcactgttactgatatacctactgacaaaacattatcacattgtctaattacgaaatcactgaattttagaggtgaaagatactcacttcataatgaaaatacaggtccttttccactgccattacttatttctctacactaaatataagtatcatatattccatataagatactatttatttatttatttattattattttttaagacatggtctcactctgttccccaggctaaagtgcagtggcgagaccacagctccctgcagcctcgaccacccaggttcaaccaatcatcccacttcagtcttccaagtagctgggaccacaagcgcatgccaccacatccggcttttttttttttcttttttttcttggtagaaatagggtctcactatgtcacccaggctcatctcaaactcctggcctcaagtaatcctcatgctttggcctccaagtgctgggattacaggcgtgagccaccgtggccagccgcttccttaattatttaaatagagataaaggcctgtaactcaaaacttttttcctgcctcacgactgttctaagagattatggagtaaagaaattatggggctaagcacagttgctcatatctgtaattctagcacgttgggaagatgaggcaggaggatcacttgagcccaggcgtctgagaccagcctgggcaacacagttgaaaaaaaagttgaaaaaaaaaaaaattagccagacacggcagcacatgcctgtagtcctagccactcagggggttcaggcaggaggattgcttgagcctaggaatttggggctgccgtgagctattactgcaccactgcacctcagcctgggtgacagagtgagaccctgtctctaaaaagaaaaagaaattatggaaaaattaattccattaagtctgaaaaactttaaatttgggatgttaaacatctcatattttgctctgtgggaaactaaggagaaataaaaagtctgttaaaagtaaacatgattcccaaaataagaaaaactaatctaagaaatgaggaattatataaattattttcaccgtagggcacggtggctcacacttgtattcctaacacttctggacgccaaggtgggaggactgcttgatcccaagagtttgaaaccagactggacaacacagtgagaagccatctctacaaagaatagaaaaattagccggtatggtggcgcatgcttgtggtcctagctacttgggaggctgaagcccaagaggtaaaggcttcagtgagccatgttcacgccacttcactccagcctgggtgacagagtgagaccctatctcaaaataaattaataaatacatttatgaagtcagtcatttcaaattgatacaactggcagataaagacaaaaatgtgtatctataaaatatttaacaaaatttctcatgacagctcatcaatctatccagaatacactatagtccctcaaggtataaaaaaataaggtaagctcaagctcacaaaacagtagcagtacatcttagtctgttttctgctgctataacagaattcccaccagactgggaaattgataaagaaaaagatttacaggatttggctcatggttctgaatgctgaaatgtccaaggacatggcactagcatctagacggccagctggtaagggccttctagctgcatcgtaacacggtggaaagacatcacatggtgagggtgcattcaagaaggtggaaagggggccaaactgccccttcagccttttataattaacccatgctcacggcaacagccttaatgcatacatatgggcagtgcccccacgacctaattacctcttttttgtgtatgtgtggtcaacttctgtagctttataccaataccactaattacctctcaacactgttgcactgggggttaagtttccaacacatgccacattcaaaccacagcacagtacatattaggatttgggcactaaccattttgtgaaccaatggagcccaaaagattctataaaaataatgcttacctgatgggtgtggtggggggatcctcacttcgagcctcattctcttgcctggcttcacagatacagctcaacacagacatggtcttctggggactaagacaatatattaaagcaatatattgttaactttgaaaagaaaagtacttttggagattatccttttatgcacagaggaaataaaatgctttctctgcatatcaaactccaaaccaccttacaccaaaatgcaaattctccatacttgttttgaattagcataatttaaaattctcaaggaagattcactggaaataaggtggacagaggactgtattaaataccataaagatgcgatcagcaaaatccagaatgtagaaaaccatacaacaatctgtaccttcaacaaataatttgcaagcaagaggcaaaaaaaaaaaaaaaaaaaaaaaaaaaagactggaggggtactctgtattttaaaagacttaaagagatataatcaaatgcaatatgcagaccttatttagatcttgagtcaaactgtaaaacaccatttatgagacaatcagagaaatctgaacattgaatatttcatgatattaaggaaccattgtcaattttttaaagtatgataatagtaatacggttaagtttaaaataagaatccttatcttttggagacagcactgaagtatttcagataaaattatataatgctgaaattatcttcaaaataattcagtagggaggggggtgctggaaatataaatgaatcaagactggccataagaaatttttggaactgggtgatgaatacatggcagtccattatactactctctctactttcgtatatgcttgaaaccttctgtagtaaaatgattgagaaataaggtgacagcaagtaatttgaacagagtacagttacaaacaacacttaaaagtttcatgtacgctgggcacggtggcttatacctgtaatcctaccactttgggaggccaagccaggtggatcacttgagcttcaggagttagagactagcctgggcaacatgacgaaaccccatctctactaaaaacacaaaaattagcccctggtggcaggtgcctgtagtcccagcaccctgtggggttgaggcaggaggatcgcttgagcctgggaggtcaaggctgcagtgaactgtgattgcaccactgcactgcagcctggttgacaaagtgagaccctgtctcaaacaaacaaacaaaaaatctccacctaaatgcagatgaaccaaggaccacttccaatattgtgacagagcttactttagatgatttgttagagtgaacacaatagcaaacaagtcgaatttttttaaatttagattcttatatagaaaaatttattcacaacaatatcaaaaatttcatctcattctaggatccaccattccaaccctctgctcaaagtttttccttattttctcctctctactttctaccctaagagttctagaagcttcagcaacatactctgttccctctgaatatgcacaagtacagactaataacaacttattcctggccaaaaattctgttaaagccaaatggaccagatacacactccactttcttcagcttctaagactatatatcattaagggatcttcaaatgaaaaaggactctacggtacttatgtttcagattaaatatactaatagcccaatgaggaactaatctctctaagacatagctaagaacagatcaaaagactttgaaaaaggtcagaaactcacaagtgaggtcacatttagtccacaggcctcttttatttgatattttatttttaaaaatccagatttctttctaaaaacaaagatgtggcaacaagaagtttgcagtttcacatgacaactactggctggagttgagtggggcacaccctttcacatggaccatacattcagtttgccattgtcctcaacactctgtcttgcgggcggatcacgaggtcaggagatcgagaccatcctggctaacacggtgaaaccccgtctccactaaaaatacaaaaaaaaaattagccaggcgtggtggctggcacctgtagtcccagctacttgggaggctgaggcaggagaatggtgtggacccgggaggcggagcttgcagtgagcggagatcgtgccactgcactccagcctggatgacagagtgagactccgtctcaaaaaaaaaaacaaaaaaaaaacactctgtcttgtacctagccactttagttattaacagtacccgcctagcctctaatttaagaattcttggtggggcatggtagctcacatctgtaatcctagcactttgggaagtcaaggcaggtggatcacttgagcccaggagttcaaggccagcctgggcaacatagtaaaatcctcatctctacaaaaaatacaaaaattagccagatgaggtggtacatgcctgtagccccagctactcaggtggctgaggcaggaggatagctggaggtcaggatgttgaggtcacagtgagccatgatctcaccaccgcactccagcctgggcaacagagcaagattctgtctcaaaaaataaaaaagaaaataaaagaagaattcttgcctatgtttcaccaactgctattagcgttttcaggctggatgactcatgcctgaaacaattgtattctcacagccaccagatggcaaagcttaccaaccaaaacctcagtatggggtcatactcgtcctcaaagcattacaacatccatgacaaagcaaaaataacagctcaacatagtagttaatttggcaggcagaagagaaaatgacctgaggctgcagctgagtatgcgattgcagaaggaacaaggtctgtagctatctcttgttaatccttctttttctcatcaattggatcaacaatcctgagattgtggagactcttgtatcagcaacagaaaaaaggggggaaaggaactctcacatgaacaaaagtaaagacatttcaattatcttagttctaggtgtagaaaaaagcttcactgaacttaaaaaagtattaactaaaaagtctatgatccattcaaaacattgctaaatcctttatgaaagagtctcattttaactttctcattttaacttttttcctttgttgataaaccatctaccctcatcaccagtagctgtgtattaaactctaaatagcatccagctttggttacctggcaacagactcagcaacagcagtagatccattttttctttcaccagttgcaggctctgaataaaaacaaaaccaaggagagaaaggaaagagaaacagaatttagttagtatcacacctaaaccttcactctgctctactagtatttgcaaaaaataacaaaaagaaataaaaataagtaaaactagtaagtataaacatacaaacatttcttgtaattttatttatttatttctttattttgagacagtctcactctatcacccaagctggagggcagtagcgtgatctcagctcactgcaacctccgcctcctgggttcaagcgatctcctgcctcaacctcccgagtagctgggactacaggcatgcgccaccacgtccagctaattttttgtattttttaggaaagacagggttttgccaagtttcccaagctggtctcaaactcctgaaatcaagtgatctgccagatttcttgttttttgtttgtttgttttgagacaacagtctcgctctgtcacccaggctgcagtgcaggccagatttgttttaatttttttttttttttttttttgagacagagtctcactctgtcgcccaggctggagtgcagtggcgcaatctcggctcactgcaagctctgcctcccgggttcacgccattctcctgcctcagcctccccagcagctgaaactacaggtgcccgccaccacgcccggctaatttttttgtatttttagtcgagacggggtttcaccgtgttagccaggatggtctcaatctcctgacctcgtgatccgcccgcctcggtctcccaaagtgctgggattacaggcaagagccactgtgcccggctggctatttcttgtaatttaatggtacaagtttttctcacttccaccaatcaattttctttcaaacttcctataaaagactaataagattggcaagaaatacaatacaatgagtaactttttttttttttggagacagagtcttactccgttgcccaggctagagtgcagcggcgtaatctcgacttgctgcaacctgtgtctcctgggttcaagcgattctcatgcctcaccctcctgagtagctgggattacaggtgtgcaccaccacacccagctaatttttgtatttttagtagagatggggtttcaccatgttgaccaggctggtctcaaacttccgacctcaggtgattcacccgcctcaggttcccaaagtgtgctgggattacacatacgagctacgacacctagcccttagcagtaatattctttttttttttttttttttttttttttggagacagaatctcactctgttgctcaggctggagtgcagtggcatgatctcagctcactgcaacctccgcctctcgggttcaagagattctgctgccttagcctcccgagtagctgggattacaggtacctgccaccatgtccggctaatttttatatttttagtagagatggggtttcaccatcttggccaggctggtctcgaactcctgacctcaggtgatccacccacctcagcctcccaaagtgctgggattacaggcatgagccaccacacccggccagcagtaacattcttaaatgaaaattaaacttctgaatccaaattcatctctgcccatataagaagttaaaaaagtatgtaataatacaaaattaaaaaccaaaaactttttaaaatttatatcatattaaaaacaaattaaaaataaaagaacttaataaaataagtagaaaatattttaggttgatgaactaattttaaatagtttttagagcacccacaaatagaaggtacccaagttcttcccaaagtgctttaggacagacacttcaaaaacaaagggtggccaggcacggtggctcactcatgtaatcccaatactttgagaggccaaggcaggaggatcgcttgagcccaggagttcaacaccagcctggctaacatggcgaagccccatctctataataaatacaaaaattaaccaggcatgggtggtgggcgtgcctgtagtcccacctactcagggggctaagatgggaggatcgcttgagcctgggagatggaggctgcagtgagctgagatcaccccattgcactccagcctgggtgacagggagaagccctgtctcaacaacaataacaacaaaaagaaacaaaaaggacattttcaagaacatgcagcaacagattaaaggtcgtactgaaaaaaatcccatattctcacaacaatgtcactaatttcaagggattaaaatttgttcatttacaatttataccagccttagagaaaacaacccttaaatggtttttaattatttctaaaatattcatgacccaacataatctaaacagtccatcagggaggcagctgaaattcagttggagccctggctctgaaatagaaacctggctcacaccctggctattgcacttaatagtccaacctaggagtaaactactttgtcattttgagtctcagtgtcctcctctataagataaaaacacaacaaacctaaaaagtttgttgtaaggatgaaatgatgtaagtaacactgaatacagtccttgatactatgctcctggtattaggaaaggtagtaaaatttactgatataaccatccttaacacttcgctagttgtaatttcagatccaaaggtaaagtaagatttaaggctatcacatactctctctcttgacaaaccctttttaaaatttttatttttgagatgagatgtcactatgttgcccaggctggtcttgtacttctgggtttaagcacacctcccacctcagcctctggcattgctgggattatagaagcgcaccaaccaccatgcctggcaataagcccttatttattccggaaaagatgatagtaaggatggaaccatgtaatactttaactcagtctactgagttgctaagattcaaatcagtaagtaccacagcatcaaagatttggaaccagacttcctggatttgtatcccggctactccatttactagctatgtttagggaaggcgctcaaccttcctgtgcctcagtttcctcatctgtaaaaggaggataataataggatctagttcatcggcttcttatgagatttaatgagctatacatgtgaagtacctggtatacagtaagagctaaaaatgtattagctaaaattacttttctctggtctcagggaagaagaagtcctgcttatccaacctattctgtgtagtcttcaatagcttcccctcccaacttcttcagggccttaattcatcaactgtttcccccaattccctcgtctttaatctatgcctccctcttttggatccttccttaacccatttatgctggaggttgcaaatttttttttgtgaaaaatcagaccttggtgatgaccttgagcagcaggatataaataactcccgcaagcttagtgttccaatagtggaacactaggcataaatgggttaaaatctgtaaacttgctcaggcctctcccagcctaaaataacaaatcctctctcaaccctgcatttccctctaactcaccatattttctcttcttctctcacataaacttctcaaaagtagagagtacatttgcagcctcatctcctcttcctcatccttcctcaattactttcagtatagctcccaccccaactgctgcactgaaatggctcttgctagagtcaccaaatggatcctaattgcctcgccgaagtcaaagtatatttccagacacatcttactaaacttgctcctgtgcctgacatgatcttcttgtaactcccctccccataggcttccatggcttcatataccctcctagttctccttctctctgaacgttcctttataatctcctttatgagatttcttcctcttctaatcccccttaaacagcttttacaaattacctgaaatgaaaaaattataagcttcagagttaggtctgactcaaattccaactccacctagcaccaattattgtgaccttagacatgtaacttaaaaacctctcttactctgttttctcatcaataaaatgaaaatgcagatacctacttgggagtactattatggaaatgagatcatacagtatatgtgaagagtcattctctctttttttcctcccccttacttccatattcacctggcaccatcgttctgcctactcgctcctcaaattcatccctcatctccagccccactaccaatgacctcactttctggttaaagactgggtagaatttaccaggcaggagaacagaatatgggaaatgcaaggaaaggaatcatcatgcacaaaagcacaaggttttgaaagactcagctgatgcttttttttaaaggcaaatctgatcatattactcccttgcctaaaattcttcggcttctcagcatgatgtaaaaagcctttcagcatctggtccctactttgcatccctcccttgtatcttctctttattctagccctaccaaacaacttctaattcatgtgggaaagaatcaacattaatctgcaatgtgaatccacagtcctaaagttttctaccctattctgaagtctttctgaatagggaaaccaattacataggaacagacttaacagaaacaagctataatatggagattataaaacagagtatctttagtaacatgacaggctggccaaaagcaaagaattaaatctatgagtgtaagactttacaaatacatttataaatatagaagtatcaattattataactagattataatcaatactccccagataatctgcagctactaattacccaagattaacataaaacttactttccaggttgaactgcaaagactcttcactcgcctcagtctcaggactaaccagtttcattcttagacataatttatcatccacgtctggggcagccccagaatccccttttccactcccaagtatgggatcatgggtctccaccatgctttcagacatgacatcactggttgctatggtgctttctggatagttgctaatacctgaaagaagtgaggcagggaggaagaaaaaaagaacactaaaatacaaacacaaaaaacagcaattcaaggtcatcaatttgcctgtttggctccacagctctgcaggattgaaggaggttcctaggatagatccctgtcataagtatcaacaactacgaactagtattgacacctggtcttaagaggagcaacaggattcagttccacttctgcatctggacaaaggatgctgcatgagccctcagccaacccacatctgccagcatcaggcataggtagcaggagactccagacggcatgattgttacctcccagcactgactagagaaaacaaataggttaatgtagaagactactggctgcttcagggaaggaggatctaagttttcttgccctgtcaagcagcagactgactaattagccaaggtactgaataaatagtacttctaccttacttcctgttccatccttataaaacatctctacatcactacttagcactcagattctactgccttgcaagtaataagataaaattcttttaagtattctctttctttcttacttccctccaccctttctttccttcctctctttacccctcatctcctagtagtaaaatcacagaaccagacttcataaccctattttccctaaaacaaaaatcaaccttaccagccagacccaactcctcagatctaaaatatcacttgtgtagagaatgatatctcagaaattctgccttaaatatcattactttttattcactcaccaataggagtactgtgtctcttgggctccaattttaggtgcccaataagaggtggggttgcaccagtcaatggtgggatgatatcaccttctttaggcaaagtgaaatgaaatggggtttctgaaaaaaaaaaaaaaaagaaaaaagaaagaaagaaaaaatgatttaaaaaaaacagaagtataaaataagcaaaaataataagaactgcaagaaatatttcaatcactcttttcctttgctcccaaattctgtctcattgccaccaccctcaccaggcctcctgactaactcccttctatcgtctctgctctcttcacagccaacaactatagtactgacacaaagtagacaaccagaggacaggcaaattgagaaagcccgaagtctgcaagacctgaggaacctggagtcaaatggaacacaaacatttgatctccaagacagtacatcaggggatatttagcaatacaaatttggacagtttcaaatcagaacaacataattttgtgcaatgctaacctaaggagtttgtttataagccttaatagtctgtaggattctccaaagcaaagtttgaagttaatacttataatgtacaatctaatcaaagagatgacagaggatctcacgggttaaaggacttcaagatactgactggttctagcatagaaatccaagggtttcatggttcagcagtacggaccagcattcactctaggcctaagtgtaatgttcatacctaaatctctgcacaacagtaaatccctcatatataagcatcaccagtgtacacattttagttattaaattattataaatagaaaatatttgtcaagacataaagctactttctacctaggtctcagttccaaatttttgctaatcagaactagaaaaccgtcaaaaaatcacattttctaatttcctaatttatctctttttataaaatgatacatttgggagaaaataagaattgcgccagactgccctcttaaaactaatatatgaaaatttcttcttactttcctgggatggctcaaaataactataatctggcatacttggacactactacttatgaaagtagtttgcttctttcatctttttccactcctatctttaatagcaagcaccgtgataattttttcctttaaaacaaaacaaaacaaaaaaatttttttttttttttgagacggagtctggctctgtcgcccaggctggagtgcagtagctcgatctcggctcactgccagctccgcctcccgggttcatgccattctcctgcctcagcctcccaagtagctgggactacaggcgccctccatcacgcccagctaattttttgtatttttagtagagatggggtttcaagagaaaatgaattagtaatctgaggagataaagagagaaaaagaaatggtctttagaaataaaggattaaagtacatatgctcagctaaagaaactgtaaagaggggccaggtaccatggctcatgcctgtaatcccaacactttgggagacgaaggcggatggatcacttgaggtcagaagttcgagaccagcctggccaaaataatgaaaccctgtctccactaaaaatacaaaaattagctgggtgtagtggcaggtgcctgtaatcccagctactcaggaggctgaggcaggagaactgcttgaacctgggaggcagaggttgcagtaagccaagatggtgccaccgcactacagcctggatgacagagcgagaccgtgcctcaaaaaaacaaaacaaaacaaaacaaaaacaaacctgtaaacagtatggatgaagaatctcaacattacatctaactgacagacatccaccatagttacagaaaagagaaatgggtcaggtagataagcattcattctgtggtagccccttataaagcaagttgttctaataaagaacttagaagagatacagaaacttaaaaaacaccttgcaaagcctcatatattccagacttctgaaaatgtgcatgaaatctttaagcagacctttctatgtgacatactatattacgcaaatgcaatatgcaagcattaatcgctgaaaatatatccctgtaacaaggtttcctttgcacagtattacataaaacttatggaaagtaattttagcaccatttatctaactgcattactataacctaatggaaaattcagacttttacaggccctagggacagcactgccactactctcctcaggtctccaatgcctcattcctggattattaccatagcctatcaatcacttcctctgcctaaagtctcccactctccctaacccccattctttctgcacactttctgcagccttcctagaaaacatggctttgttagctcctggtcaaaaaacttcaaggttttcactagaagacaaattcccaactctatagtcagcattcaactaactagtagcagcctatatctccagtttttctttaattattcacgttcataaagcttctattcaatgtcctccaaaggtttcccatttctatgcttttgttccctcatctggaaaacaccacacatctactcaaactattgccaaatccttaaaaatacatttgctggtatattttatccttttaaacttacggaattttccacatattccattatttctctaacatttagcaatcctacattctttaaattatcaaatcccttcttgtttttccagataatcatgggctatcatgttgtaggtcagcataccaaacaataatgaaggatatgaatgaggaaacaaaaggaaactcaatactaattttgaaaccacctgagtgggagtatgtgtcctttaaggactttagagaataactccaaagcaatatttaaaactctaaatgttaagaaggtctctcctaactttctgttatagttttaaacccatttttcttctttgttcttaaaagaactggttacccctaagaatttattaaaagccatctagttaaaaatgtaagaatttatatatccggcgatatcatgcatgaagtctaccccaaaagtctgcctctgatattaatagccaattaagatggcattctatcaagtaagcaaataaaggttatagctagagcctaaaacacatctagatcccctgatcattattaactattacagactattacttatggatttaaagacttactgaactccttacagtttttcacatcatcaacccaccaaatatttgttctgtgttgaacaagattgggcttccaagtaccatcttgcttttttacaggtttaacaggagctctccatagacagatacttgaagaggtctccaaactgttaacagtgacaagttatctataaatggagacatttaaagtaattctctctctccctctctgtactcactctctcttttccttccaactccctctctccccacaccctccccactcagaatctctactttgtattgtttgaatgtttttcaaaattaagcatgcattatttatttacttatttatttgagacagggtctcgccctgttgcgcaggctaaagtgcagtggtgcaatctcagcttactacaacctccgcctcccgagttcaagtgattctcaagcctcagcctcctaagtaactggaattacgcgtgcacgccaccatgcctggccaagcatgtatctttttttaaaatcaataaatctattaacaacaaaaaagtgctcttctaatagtagatgaacaaatgcaaaactcacccaattcacacctttcattctgtcttttcagactgaagaaccattactttttttctttttttttttaattattatactttaagttttagggtacatgtgcacaatgtgcaggttagtcacacacgtatacatgtgccatgctggtgtgctgcacccatcaactcgtcatttagcattaggtatatctctcaatgttatccctcccccgtccccccaccccacaacagtccccagagtgtgatgttccccttcctgtgtccatgtgttctcattgttctattcccatctatgagtgagaacatgcggtgtttggttttttgtccttgcgatagtttactgagaatgatgatttccaatttcatccatgtccctacaaaggacacgaactcatcattttttatggctgcatagtattccatggtgtatatgtgccacattttcttaatccagtctatcattgttggacatttgggatggttccaagtctttgctattgtgaatagtgccgcaataaacatacgtctgcatgtgtttttatagcagcatgatttatagtcctttgggtatatacccagtaatgggatggctgggtcaaatggtatttctagttctagatccctgaggaatcgccacagtgacttccacaatggttgaactagtttacagtcccaccaacagtgtaaaagtgaagaaccattactttttagattactatcatttaaatttggccaggcccagtggctcatacctgtaatcccggcactttgagaggccaaggcaggtggattacttgaggccaggacttcgagaccagcctggccaacatggcaaaaccctgtctctactaaaaatacaaaaattagccaggcatggtgacatgtgcctataattccagctactcaggaggctgaggcacaagaatcacttgaacctgggaggcggaggttgcagtgagccgagatcatgtcactgcactccagcctgggcgacagagcaagactctgttccaaaaaaataaaaataaaattagtctctcaacatttagcaactaaacaactatatttttaagtacaaaataatatttttctgttctttttgcaacgctcttctgaatgatttattttatacaattttctaagttaaaaactattgttctcggctgagcacggtggctcatacctgtaatcctggcactctgggaggccaaggtgggtggattgcctgaatccaagagttcgagatcagcctgggcaacatggcaaaaccctgtctctacaaaaaatcagccaagcatgctggtacacgcctgtagtcccggcttctcggggcggggggctgaagtgggaggatcacctgagcccgggaggtcaaggctgcagtgaacattgatggtgccactgcactccagcctgggcgacagagtgagaccctggctcaaaaacaaacaaaaaaaaagacaaaaagctattattctcccttcatgttctaatttgtagttaaaattatttttatttaacttctcctcataaatactattttccaaccactgtcttcattactttttgttgtttgcccaagaactaaaatcatgaaataaacacgaaatcactagcattttcaataatctggatattaatgttaataaaataataagttttactacggcaaaaaaagctgactctgccaattaacaatgtaaacaagaattcatgaagaatactattaaaataatagaatatctcactgttttagaagcttcttttgcatttaatttaaaagtactccaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccggacgtggtggtgggcgcctgtaatcccagctactcgggaggctgacgcaggagaatggcatgaacccaagaggcggagcttgcagtgagccgggatagcgccactgcagtccagcttgggcgaaaaagtgagactccgtctcaaaaaaaaaaaaaaaaaaaaaaaaagtactccaaaataactatattaaaacaatcaaagagacctgatattttgttggcacaggtcattagcagtatttaaacataatacaattagaaaaatactctactacagaattttaggttattcacattgttcttcactacagctcttcagaatcaaataatctgtattaagcagttttacaggaagaaaaagcacagctgggatcaggagacctaggttctagtctcacctctatcattaactagccaaaagacgttaagaagagactaaatccaataacccctcacttcctttttagctctaacatttcttattcttaagataaaaaaaaagtgctaaatataaaagctaataaatagggactttttttttttttgaggcggagtctcattctgtcacctaagctggagtgcagtgatacaatctcggcttctcgtgcctcagcctccagagtagctgggactacaggcacccgtcatcattccaggctaatttttgtatttttagtagagatgaggtttcatcatgttggcaaggctggtctcgaactcctgatctcaggtgacccgcccgccttggcttctcaaagtgctgggattacaggcgtgagccaccgcacccggccaatagggacaatttaaaaactaaaaaaaaagtactattaataatcacacttagacaatgggtataaaatgggactgttctaggctgggtgcagcggctcacgcctgtaatcccagcactttggaggccgaggaaggcagatgacgaggtcaggagattgaaaccatcctggccagcatggtgaaaccccgtctctactaaaaatacaaaaattagctgggcatggtggcatgcacctgtagtcccagctactcgagaggctgaggcaggagaattgcttgaacccgggaggcagaggttgcagtgagctgagattgcgccactgcactccagcccagcaacagagcaagactccacatctcaaaaaaaagggactgttctacgcaaaccaaaaaatatggtcactcatactatcatatgtaaacctgccaaatactgttttttcatttcatcctaaaaacttgttttcttaagtttgtgtcttgttattttgtttttggagcttgattttacattataataactctttttttttttgagacagagtttcactcttgttgcccaggctgtagtgcaatggcgcaatctcagctcatcgcaacctccatctcccgggttcaagtgattctcctgtctcagcctcccgagtagctgggattataggcgcctgccagcactcctggctaattttgtgtttttggtaaagacagggtttctccatgttggtcaggctagtctcaaacttccgacctcaggcgatctgctggcctcagcctcccaaagtgctgggattacaggcgtgagccaccacgcctgacctacattatactaactctaaggattcagaaagattgaattattttcagctaatgtcatactctacaaattattttattttatttttgggaaacagagtctcactctgttgcccaggctgcaatgcagtggcgtgatcttggctcactgcaacctctgcctctcaggttcaagcgattctcatgcctcagcctcccgagtagctggaactactggtacacacgacacacctggctaattttttgtattttagtggagatgggtttcaccatgttagccaggctggtctcaaactcctgagctcaggcaatccgcccaccttggcctcccaaagtgttaggattacaggcgtgagccactgcacccagcctgtacaaatactttagaaagtaatctacgttttcatgctgaatttcataaaataaagaacaagaactaatacattttccagtttcaggtttaagagatatgtattttttgaactaagtttagaaactttacctaatgcccataaaaaggaaataactaattaataggatactcatcaacagttctgaatgtgattttaccacacagagttaatcaaaaaagatccttctacttcaaggcaactgtcaaaatctatacacagagagcaaggatacaatctaagtaaaaaaaaaacagattggtacaatttctaaatattttttaccaactagtcccgagttacaaagctgataaacctcaaatatctttaattgcacaaataattatagctattaaaaaaatacaatccaggttgggcgtggtgactcatccctgtaatcccagcactttggaaggccaaggcaggtagatcacttgagtcaggagttcgagactagcctggctaacatggtgaaaccccatctctactaaaaatacacaaaaattagccagatagtggcatgagcctatagtcccagctacttgggaggctgaggcacgagaaatcacttgaacccgggaggtggaggttgcagggagctgagactgcaccactgtactccagcctgggcaacagagcgggactctgtctcaaaaaaaaaaaaaggcaatccaaaaaatttaatttcccaattattattggttgttcataaacataaaccaaagatagtgttcactcctgacataagcatgcagttctcgccaactttccattccagattataatttaggtggagacaagaataatctacaatcacactcaccactagaactttcacagaagctttgtgaggcatgggcagagggcttccccagcttctgggcctctgcatctgagcttagctgctttgcattagccatttttgagtcttctgttaatgaattacttgttttctcctgagtttggggctgctgcaactcctggtcaagtcttaaaggatcatctgctctcactaaaggtaaggaaggctgtgaagaatcttgctctacaggttctgtttctgcagtccctgatttcagatctccttcatattctacactcttttcttccttggtgtctaatctattctcagcacatggttctatttctggagcaatatcctcccatgactgggaatctgagcacttctccactccctccaaaggttcacaagaaacatcaactctgggagatggctctttcacatctacaatgacaacactggagtcctctgaagtagcttcttcccaagcttcctgttccttatgttccaattcttggtcaagtattgccaacttttgaggggaatcaatactaatcacactggtttcaacttccatagcttctgagcattctttttttggcatttccttttgaagacacaacccttgggactgagtttcagtcagagaaaggtgcaacggaacactctccatattttcttctttgagttcctctccttgactttcacaaggtgtctcagggatttcttccacctcagaccctgaagacccctcctctggatggtgttctttaatttccatagcttcctcctgatctaacacactagaaagtgcctcagatcgagtagctggtgacggaactgcctgactccccgaatcacaagtgagatcaatacaaacatcttctgctaccgtttcttctctgcccttgcaaccagtggctaaaatactaatgtcatccctggtgtctgtatcatctccctttgttttgtcatcattctgactcagttgtacttcaccatcctgtgctggattcatcaggatactatcattttcagcaggaacaaatttagaattgagaactggagacatgggttccgtatcctcaatctgtgtgttttctccatcttcatcaattctgtgagaactcaagctctccatctttggggactgactatattcacttgtagaaagcatcaacttgcaagaatcccctgtcaaagatagcccaagatcctcaggggaattctttggttcaatctctgaagttttagaacactcaactgtcaaagatgaactatgcatatctccatctttcttcccatcatttgattgttcttccagacttggggaaggaataaaaatgtcctaaggaagaacagaaagagacaaattgtaatttgtacatgatcatatatcttttatatcgaatccttggattcatataaaatttctaaaatcaaatttctaaatcaaatttttaaattcatataaaatttctaaatcaaatttaagaattaaagaactctagtatagccaggagcagtggcacatgctccagcccatttcagttctcacaaagtggggatacgtactcattttacttcacgatttcaaaatgtgctagcattcaacacggtgaaaccctgtctctactaaaaatacaaaaaaatcagccaggcgtggtggtgggcacctgtaatcccagctacttgggaggctgaggcaggagaatcacttgaaccttggaggcggaggttgcagtaagccgagattgcaccactgcactccagcctgggtgacggagtgagactccatctcaaaaaaaaaaaaaaaaaaaaaaaaaaaaaaagctagcattcataaagcaggtattaaaatccagtggccaggtgtggtagctcatgcctattatcccagcattttgggaggctgaggcaggtatatcacctgaggtcaggagttcaagaccagcctggccaacatggcgaaaccctgtctctaccaaaaatacaagaattagccgggtggggtggtgcatggctgtaatcccagctactcaagaaactgaggcagaagaatggcttgaaccgcggaggcagaggttgcagtgagccaagatcgtgtcattgcactccagtctggattacagagcaagactccatctcaaaaaatagtaataataatactaataataataaataaaatccaaagcttacaaaatatcaatagtcaacagagaaatacaaattaaaatcacaatgaaataccactacacgcaacaaaagcaactaacataggccaggcacggtggctcacacctgtaatcccagcactttagtaggccaaggcaggcggatcacctgacgtcagaagttcgagaccaacctggccaacatggtgaaaccccatctctactaaaaatacaaaaattagccgggcatggtggcgtgcacctgtagtcccagctactcacaaggctgaggcaggagaatcacttgaacccaggaggcagaaggcagaggttgcagtgagctgagatcgtgacattgtactccagcctgggcaacaagtgagactatatctcaaaaaaaaaaagcaaactaatgttaaaatagttcacaaaacagtcaggcatcgtggctcagccagggatggtggctcacacctgtaatcccagcactttggggaggctgaggtgggaaaactgcttaagcccaggagttcaagaccagcctggacaacatggctacaccccatgtctacagaaactttaaaaattagccaggcatggtattgtgtccctacagtcccagctactcgggaggctgaggcagcaggatccttgagccacaggagttcaaggctgcagtgagctattattgtaccactcactgtacactagcctgggtgacagagaaagactctgtcccaaaaaaagacaaaaaaaaaaaggttcacaaaacccaggattagcaacgatgttgaacaactgcaactctcgtacattgctgctgggaatgcaaaatgttacacccactttggaaaaacagtatggcagtatcttataaagttgaacattcattactatataacctaggcattctgcttgtaggcatttacccaagaaaaataaaaatatgtgcccacagaaagatgtgcatccaaatgatcacagaattattattcgtaagatgtgcatgctggccaggcacagtggctcacatttgtattctcagcactttgggaggccaagacaggcagatctcttgaggccaggagttcgaggtcagcctggccaacatggtgaaatcccgcccctactaaaaatacaaaaattagctgggcatggtggtgcacacctgtgatcccagctacccagaggctgaggcacgagaattgcttgaacccaggaggcagaggttgcagtgaggcaaaatcacgccactgcactccagcctcagcgacagagcgagagtctgtctccaaaaaaaagatgtgcaaatgatcataggattattattcataaattcatgggaaattattcatatattcactcatataatggtcatatattaattataattgaatagattattcaaaataaccaaaaactagaaccaaatgtcctatcaattggtgaatgaataaacaaattgtggatacacatattatggaacactatccaacaatataaatggaataaaatatgaatatgtataatacaagcaaatctcaaaaatatgctaagtaaaagagctcaaaaataaaagaccacacacacttcctgattccaattgcatgaaattcttttttttcttttttttttttaaagacaaggcttcactctgttgcctaggctctggagtgcagtggtgagatcacagctcactgcagcctcaatttcctgggctcaagcaatctctcacctcagcctcccaagtagctgggaatacaggtgggcgccacaacacccaggtaatttttaaaatgtcttttagaaatgggatcctgctatattgcccagacttgaaactactgaaataccaaaactatactgacagaaagctgatgtgtgattgcctagggcgggagaagggagtatactgggcagcagggagatcaaccacaaaaggttataaggaaactttttagggtgagggaactgctctctactttgatggtggtgatggttacacagctgtatacatttgccaaaattcatcaaaacatacacgtaaaataattttattttatgtaaccaatacttcaatatttttaaaaagagaaattaatacaaaacttagctgtttttataagagattttacatttagtgtgttattttgcctaatgtaaatgatgtaaaactcccaacatagatggttaggcattcatttcctatgttttgttttgttttgttttgttttgagacaaggtctcgctctgccagccaggctggagtgcagtggcttaatcacggctcattgcagccttaatgtcttggactcaactgatcctcccacctcagtctcccgagtagctggaactacaggtgcgcaccaccagagccaggtaatttttgtattttttgtagagagggtctcattttgttgcccaggcttgtttcaaaatcctgggcttgagcaatctgcccagcttagcctcccaaactgctaggattacaggcatgagccaccacgctcaggctttttttcctatgatttttaagggaatgaggaatcaaatgggtagtaaagcattctgtatattccataacttctgatatttcaatgtctggtattattgtttatcctatcagattgtaacaatgatcctaagtttgaatctgttcatatactctcagacatgactgagtataaactggttcaagccagatgcagtggctctaacttataatcccaacactttggaaggccgaggcagaaggattacttgagcccaggagtttgagataagcctgcgcaacaaagtgagaccctgtctctaccaaaaaaaaaaaaaacattagctgagtgtggtggcacacgtctgtggtcacagctacttgggagcctggatggttaaggctgcagtgagcagtgtgattgtgccactgcactccagcctgtacaacagagtaagaccctgcctcaaaaggaaaaaaaaaaaaaaggttcaacatttctaaatggcaatttagcaaaacacaacagccctgaaattctataccccataatccaataattccatttctgggaaattaatcaatgaaagcacactaatacttagctacaaaatggttcactgctatattattatttagaataggaaacaatatgaaataccttaaatggttacaaataggaattttattttattttttttttgagacaggtcttgctctgttgcccaggctggagtgcagtaatgcgatcatggctcactgcagtcttgacctcctaggctcaagtgattctcttacctcagcctcccgagtagctgggaatacaggcacacaccaccacacctaattttttagtattttttgtagagacgagattttgccatgttgcccaggctgatcctgaactcctaggttcaagcaatctgcccacctcgaactcccagagtgctgggattacgggcatgagctacctcgtccggccaagataataatttttaaattgtgatctatcacatgatagaatgttttgtggtctacataaaagtatacagtagaagaatactaaaagatcaaaaaacatttgggctatagaaagaagtttctattttagtaaaaaattatgtggatatacattatatttttttttttttgagacacagtcttgttctgtcacccaggctgaagtgcagtggcaccatctccgctcactgcaacctccacctcccaggttcaagtgattttcctgcctcagcctccagagtaactgggattacaggtgcccgccaccacacccggctaatttttgtactttttagtagagatggggtttcaccgtgttggccaggccggtctcaaactcctgacctcaagtgattggtctgcctcggcctcccaaagctgggattacaagcgtgagccacagaacctggccattctactctttttacacattttataatatataatcttcatgtaattttagttaataaacatatatcaaaaaaagctaagagggccaggtgtgatggcttacacctgtaatcccagcacattgggaggctgaggcaggtggatcacctgaggtcaggagttcgagaccagcctgaccaacaaggtgaaaccccatctctactaaaaacacaaaaatttgccagacacgtggagagcgagacttcatctcaaaaaaaaaaaaaaaaaaaaaaaaaaaaaaaaaaaaagctaagagttgttatttctgaggtagaataactaatgatcttatcttctcttttttcttttcttcaagatggggtcttgctttgtcacccaggccagagggcagtggcacaatcatagttcactgcagcttcaaacacctgaactcaagcaatcttccccgctcatactgctccccagcaccaggagctgggactacaggcacacgtcaccacatccggctaattttttttttcttttggtgggtagagacgggggcctcactatgttgcccaggctgctgtcacactcctagctcaagctatcctcccaccttggcctcccaaagcactggtattacaggtgtaagccaccaagcatgaccacatcttctgcaagacatatgtattttttcccttgttgcaaaaaataagtcattttacaaagtctcatagataaaacatcactaacgtaaagctataaatacctttttttaaatgaaactcacaatataaaattaacccattttaaactaaacaattcaggccaggcgtggtggctcatgcctgtaattccagcactttgggaggccaaggcaggcagatcacttaaggtcagaagtttgagaacagcctggccaacatggtgaaaccccatctctactaaaaatacaaacattagctgggcatggtggtgtgcactttttgtcccagttacttggggtgctgaggcaggagaatcacttgaactcaggaggaggaggttgcagtgagctgagatcatgccactgcactccagcctgggcgacagagtgagactccatctcaaaaaaaacacaaaaacaaaaataaaataattcaatggcatttggtgcatttacaatgttatgccaccaccaccactattctagtttgaaaacatttaattgtctaatttgtcctcaccaaaattaatacatatatcaagaatgagaaaatgttaactatcaaactgtgttctactaatcctctccccatccctcatatcttggtaaagggtcaaagaggctatgcaattgacaagtttattaggaaagaaagaaaaaaatagacaaaattacctttatcccaattttctcttgaatagtactaatctctttacacatatttaaatcttacaacatcaaaattaggttgacttggactccagtaaccaaggtacaaaagaaataacagatgaacaagggttacccattaagaataacaagaataagtttgacatataatgaaaaaagtagggaacttaatagaaatggagaactaaatatacacatattcagagttttctgaaatcccattaagtaatggtaaagggatttttcttaagcacaaaacttcaagaaaaagagaacagaagaaaagagaactgcaaaaaaaatctggaaaaggtaatctatttagcagaagagtgaaagctgaattcctaagccagcagtggagaaagccaacaaaccaccagagttacaccacagttccaacacccataatctcaccctgcccctcctctgccctggagagagtaaaacagagtgtcccaggactggcagacaagaggcacagttatcaggaagtacaatactgaaaatacggagattaaatgaaaatctacatattgaatgaaacctgcacctgcctcccaaccccccttcccacccaaagcccgcttccattaatagacctctagtacagccaggccaataccctgcaaataggagatcagacattttcctaagggatctgaccaggccaagatgaatcaagatactgacattatgggactcccaataaaatgtctcagcggatcacattacagcaaatcccaaaaacaataagacccaaccacccactcagaactactaatcatctgtctgatatttcactcttgaacatcagcaaataatcaaagattaccagacatctgaggaaagcctctaatttgaaagagatcaaaacaaacaaaactaaagtccacctggaagaaataggactattccagacagaagaaaactgttattaatactgttacagagataagatagtatatcaataaaacaagagaaatggtatttaaaaatatattctgaaaaaagaatttagaaattaaaaacccaagagtagaaattaataactaagagaagaattaaaagatggttgaactgggcaatggcacctgtaggtatacataagagaaataaaaccatgttcacacacaaacttgtccataaatgtacatagcagcattattcacaatagccaaaaggggaaacaacccaaacgtccatcaactgacgaatccatgagtaactgtggtatatccacacaattgtattattcagcaataaaaaggaatgaaggccaggcgtggtggctcatgcctgtaatcccagcactttgggaggccgagacaggcggatcacctgaggtcgggagttcaagaccagcctgaccaacatggagaaaccccgtctctactaaaaaaaaaatacaaaatttgccaggcatggtggtgcatgcctgtaatcccagctactcaggaggctaaggcaggagaatcgcttgaacctgggaggcgaaggttgcagtgagccaagatcatgccattgcactccagcatgggcaacaagtacgaaactccatctcaaaaagaaaaataaataaataaataaataaaaaaggaatgaaattcttttttcctttatattttttatagacaaggatagatcaatacaaaaaaaggaatgaaaatctgatacatgctacaacacaggtgaatcctgaaaacattatgctaaatgaaagaagccattcacaaaggctatatattttataattccatttatatgaaatgtccagaataggcaaatctatagagacagaaagtagactggtgtctactttccatttgtagactggtgtctacaaatctatagagacagaaagtagactaccctcgaagggccgagggtagaagaaatgttgagtgagtgctaaagggcatgggttttgaggaggtgatgaaactattctgaaattagatcatggtgatggttgcacaactctatgaatatactaaaaaccactggattgtgcactttaaatgggtaaactgaatggtatgtgaattacatctcaatatagccactgtttttttaatgattgaagaaatcacccagcaagttgaactaaaagagacagagatgatcaaaagtaggaggcaaaataaaattagaagactattctaggagtttcaacatccaaacaacagatagtccattaaaaaaagaagaagaacagagaaaacaaaggggaagaaattaaagaaataaatttctttgaactgaaggacctgagtttctaaattgagagggcctgccaagtacccaatacaatgaatgaaaatagacgtatcccaaaggtctggaaatttcagaacactgggaacgaagagaaaatcctacaggattccagtaaagaaaaaccagatcacctattaaaagtcaagatcagactgccttcacactgttttgttttttgttgttgttgttgttgttgttttgttttgttttggtacagacagggtctggccatgttgcccaggctggtctcaaactcctggcttcaagtgatcctcccaccttagcctcccaaagtgctaagattacaggcatgagccaccatggctgacctgaccctcacacttaacagcagcactggaagttggaagacaaaagagcaatgccttcaaaatctttaaaggaaaattatttccaatctagaattctatactcctgcaaactacaaatcaagtgtgatagcagaataaaggctactaaacaatgtcccccaccaaaatgagggagtaaaccaagcaagaagatatgaaacccaagaggtatccaacacagacaggtaaggagaatctccacggatgacagtgaacggaggttaacagttatgcaccaggcatagagggcaacagtacagattagaaatcaggagggtccaaaagaggtttctccaaaaagatgaaacagaaagtctaaggctcctcaacatcctgaaaggagtttctgacaattggtggagaatctagggttgatttaatgagagtcaaagaaaactaaacaaataaaaaaagacaattacaatttcagagaaaagaaacatgaaaaactattaataatatgtcataggctctgctgtgaattgtttacatagttataatgtaaactcagtaataatctaaacaaaattacgatgtaactatacttggaaaatggctaaaatttttttatgaaaataggctgggcacggtagctcacatctgtatgtaatcccagcattttgggaggccaaggcaggaggtctgcttgagcccagtagttcaagaccagcctgggcaacatagtgaggtcccatctctacaaaaaaatttttaattagccaggtgtgatagtgtgtgccactagtcctagctactcaggaggccgaggtgggaggatggcctgagtacagaagttcgaggttacagtgagctatgattgctccactgcattccagcctgagcaacaggtcaagaccctgtgcctaagaaaaagaaaatataatcatgctatgtagaattatggaggtaaataccaaaagaaaaagcataaagaacgaaaagtggttatctttgggtaggaagaggaagaggccttgttttaactatctgacttatttttggggttttacacatgcttattaagtaaaatcaaatctttaacttaaaagctatgttgtaaaggtattcttttttttttttgagacaaggtctcactctgttgctcaagctgagtgctgtggcatgatcatggctcactgcagcctcaacttcccagattcaagcaattctccaggcaattctcctgcctcagcctcctgagcagctgggactacaggcacacaccaccactcctggctatttttgaccatttgtagaaatggggtctcgctatgttgcccaggctgttctcaaactcctgggctcacgtgatcctcccacctcggcctcccaaagtgctgcaattataggtgtgggctactgcgcccggcctactaaaggtattcttgagagacttttcaggaggcatggactgcactggctaaggcatcttataaaatatgagttcaaagaaacctgattagagtcatcttaggttccaagaatctctgaactatgttcagaatcactcatttgtctcaaattttcattgctgattttttagctaattctgaaggtctttggtaaatgttgaaaatagagcaattccttcaacagtgccttgtttttcaaaacgtccattctccctttgtggccaggcatcatctccacccccccaaccagcaggaatacctttccaaagaccataaaagtctcgtttggtcactgataaacatctgtaaccattttctttaaatcagtgttggaagaatcttctcagtgctctgtgtcagtgtttatagctcattcttaaactctttttttttttttttaagacagggcctcactgttgcccaggctgcagtgcagtggcgcgatctcagctcactgtaacctctgcctcctaggttcaagcgattctcctgcctcagccttccaaatagctgggactacaggtgcgtgccagcatgcctggctaatttttgtattttttggtagagactgggtttcactgtgctggccatgctggtcttgaactcctggtctcaagtgatccgcctgcctcggcctcccaaagtgctgggattacaggcatgagccaccacacctggtcagatttataactttttttttttttgagacagggtcttgctattttgcccaagctgttctcaaactcctaggttcaaatgctcctcccacctcaatctcctgagcagctgagattacaggcatgccccaccatgcccagctatgttcacatataacttagaaaaataaaagctaaagaaggccaggtacggtggcccacacctgtaatctcaacacactgggaggctgagagaggaggattgcttgagcccaagagtttaagaacagccctggcaacatagtgataccccgtctctataagaaaaattaagaaattagttgggcatggtgccatgtgcctgtagttccagctacttgggatgctgaggtgggaggatcacttgagactgggaagtcaaggctgcagtgagccatggtcgcaccactgcactccagcctgggcaacagaccaagatcctgtctcaaaaaaaaaaaaaaaaagctaaagaaaatgatgtatggttcgaacatccatttcacctctaggtaaccttgtttttaaccctttcactgccaacaacagctacccttatatgcagtaccaagtgcaaggcactagtctaagcattttatatatattaactcaacctttcataaacatcctacgaggtagacagtatcaatatccccatcatttgactgatgagcaaactaagattcaatttcaattggtcacaaaggtagtaatgacagagccaggagcgagtccaggaagttctgactctagagtcctcatttttaataacgctaccaaattctaatgaactgcataaaatgaaatcctttaacaaaacaagttttaaaactccagaaaacaaatcaatttcttcctactgtcccctcctcactaaatttacagttcattactattcattttcaaattttacttttaaatacaaactcttgttataacacctgcaaactgaaaggggtaaaataagttgtcccaataaaactacaataattcccccacttaaggtcttataagaataggtatttagattgaatatataatagtcatttagatttaaggattttcaactcagtatgaaacctgaatttcatttctttaaatatttaaatttaaaattatacaaattaatagttttccctcgcttttagaagaaaatacacattggaaaactaaaaaccatcttgataccctaagtataggatgatcctgtactgagatcacatctacttagagaaataatacatgacttttgaaaggataagtgaagacaatataacactgagaattattacgacacaacattaactggaaaaagaaaattaaagttgtgctatataaacaccttttttaaaaaacataagcatgtgggggcacatatcgtcaggacctcctgaggctgtgtcataggcaaaaaaatttattaaaaaaaaccataagcatgtagaaagacaaaaattacagtaacagttgtgttaaagtagaataatgatttatgtcacttcgcaattttgcagtaacattttcaaaaagtttaaagacattgtaaaaagtttaaacataaaaaaaaatcaagatgttaggtgactttggaactgttctaaaactgctttgtgacgacagcttcacaactctgtaaatttactaaaatatcacaaaattatacatttaaaacgtgtgaattttatggtatgtaaattataccccaataatgctgctttaaaaaaatatgttaggagaaacaactctttttacaatactcacatgagaaaactgaggctgggatgggataggaagtgacccaggagggaagactggtgtgctctgagatattggtgttgaggcttgtggtgatacagtggactcaggcaggagaggggggttttctaactccactggttcaccactttgaagtttcttctgaaaaggctctcctccttcttcagataacactgacgtgtccattggcttatctggtttaaaacaggagaaacaaattgagaaatatcactcatcaatattactcatgttccaaaaccactaagaacaattacactacagacattttcactctaaaaaaatagtgacgtaatttttcagaaaagctgacagaataatagtagactgggtcctagcaatctaccaatacttcctttggttggcggagcagtccaagctcctatttttaggtatagatcaaaactggatgcatctggggctacccacccattcataaaaaatgttaaattaacttggctcctttcctgattttatagctcagtttttcacatttcctgtagaaaagcccaaactactggtacctaatttaaccatcatatattctaccacaggccttgaaagacagtgaatttgtcaccactttaggtaaatacagtatctataattcatatttacgaactgattatatttgcattaacaattgctaactgcagagagatggatgcctgtacaaatacagatgaagaaaaaaaatctatcaatgccaatcagcactgatttatcaaagaactaagaaagagaagacactaatcctgacacacattaggagggaacacacacacacaaaacacaaaacactgctttcccatagtatactacccacctgtaggctatcaggaacttgcttggagtcagcccagctagctaagtatttgattcatcatttgtatcccctatcttacaacttgaccccaaccaggcttcctctagaccactcacaaactactaacaacatttaccttttccccataattcacattcatgctaccagctacccaaactgcaacctcaatacccagctttgctgcttagcttagtctcaaccttaccagtctacacctaatttgggatccagtgctacaggcctttaatatactaccatagctgtgctaagtatttttgttgcaccttttgaactttcttgccatgacaaagcacattaaaaacctgctgttataggcactacatacaaaaaaggctttaggttaagagaaaagcaaaaaaacaaataaatacaaaaagcacatatagtttcacaaacactgatgtacatacatattaagcaaatgcattaaatctaaaatataactgacaagggaaaatacactgttacataaaaaaaaaaaactgagtcatatacacaacatgccaattatgtaaaactactttatgcattgaaaactgaaatatatccaaatatactagttgtagctatatctggagtgtagtatcacaggtgatttttattttcattaatttcctatatacttaacaaactttctacaataaatattgactgtttacaatcagggagaaagcttttttttttttgagacagggtctcgctctgttgtccaggctgcgacgcagtggtgccaccttggctcactgcaacctccgcctcccaggttcaagtgattctcctgcctcagcctcctgagtagctgggattacaggcacccgccaccacacccagttaattttttatatttttagtagagatggggtttcaccatggtggccaggctggtctcaaactcctgacctcaggtgatctgcccaccttggcctcccaaagtattgggattacaggtgtgagacaccgtgcccagcctgagaaagtatatttaatataattatttttatattttttcaatgttcacactacagataaaagataaaagaaactgttttaagaattaaccaaacttcacttgtattacctgggtttttgtagaattaattcacctaatcatgttatacttagattgatatcagtcactaatcatgttatgcttagattgatattagtcaatttggatacctacaactgattttaagagaaacagccagagacaaactttgtagcagaagaaagcctaagatcaaattctatcactgataaattacatttgaaaaactgttaaatgtctatgttttatgttactcaagagcagagaaaggatataataggaggcatatacatgacagatgaaggcacaggctctggaggcagctgcctgagttcaaattctgcttctacatctcattagttgaaaaatctctctatgcctccatttcctcatctgtaaaatggggataaaaataacacctccttcttaggatgtttgtgaggattcaatgagaaaaaccacagaaatgcccttagaacaatgccttgcctatactaagtgctcaataaataaaactattataccattacttgtatatgaaagagtgaaaagatgaaaatcatagaatttattagaaaaagctttgtagaaatcgtaagaacttagaaacatcttgaatgactggataggagactaggtcagagcaaaagaagcttaaataatgagataaattaggtaagtgaaaaggaaagctttcttgtgaataaagtaatataaaatctctaagtcgtcaaaggagtaaatgaatgaagttaaaatttttaccacctactcttaaccattcttatgctaaaactattttaatagcaaaaataacctataaggaccacaagaaacaattgctggttccttctcaccagaaatgtgttcacgtgttgctagaaacaagtaggccattattaataagtccagttcttccccatactaattcatttcagttcaactttaaaaacaaaaatttttccttcagagcctttttaaaaattgagccaatacagaaatctcaatagaattagtgctagaaaagcaaagaatgggggatggtgtgtccagaattggtgggttcttggtctcactgacgtcaagaatgaagccgcggaccctcacggtgagagttacagctcttaaggtggcgcgtctcgagtctgtcccttctgatgttcagatgtgttcggagtttcttccttctggtgggttcgtggtctcgctggttcaggagtgaagctgcagaccttcgcggtgagtattacagctcttaaggcagcgcgtctagagttgttcgttcctcccagtgggctcgtggtctcgctggctttaggagtgaagctacagacctcgcagtgagtgttacagctcataaaagcagcgtggacccaaagagtgagcagtagcaagatttattgcaaagagtgaaagaacaaagcttccacactgtggaaggggacccgagcgggttgccactgctggctcgggcagcctgcttttattctcttatctagccccacccacatcctgctgattggtagagccagtggtctgtgctgacagggggctgattggtgcatttacaatccctgagctagacacaaaggttctccacgtccccaccagattagctagatacagagtgtccacacaaaggttctccaaggccccaccagagtagctagatacagagtgtccattggtacattcacaaaccctgagctagacacagggtgctgattggtgtgtttacaaaccttgagctagaaacagagtgccgattggtgtatttacaatccctgagctagacataaaggttctccacgtcccaccagagcagccagatacagagtgtggattggtgcattcacaaactcagagctagacacagggtgctgactggtgtgtttacaaaccctgagctagatacagagtgccgattggtgtatttacaatccctgagctagacataaaggttctccacgtcctcaccagactcagcagcccagctggcttcacccagtggatctcgcacgggggctgcaggtggagctgcctaccagtcctgtgccgtgctcctgcactcctcagccctttgggtggtcgatgggactaggtgccgtggagcagggggcagtgctcatcagggaggctcagccacacaggagcccacggagggggtggaaggctcaggcatggcgggctgcaggtcccgagtcctgccccactggaaggcagctaagtaaggcccggcgagaaatcaagcgcagcgccggtgggctagcactgctgggggacccagtacaccctccatagccgctggcccgggtgctaagcccctcattgcccggggggccggcagggccggccggctgctccgagtgcaggacccgccaagcccacacccaccaggaactccagctggcccgcaagcgccgcgcacagccccggttgctgctcgcacctctccctgcacgcctccctgcaagctgagggagcgggctccagccttggccagcccagaaaggggatcccacagtgcagcggtgggctgaagggctcctcaagtgccgccaaagtgggagcccaggcagaggaggcgccgagagcgagcgagggctgtgaggactgccagcacgctgtcacctctcaatggggttagacaaaaaaaaaaaaaaaaaaaggaaggaaggaaaagcaaagaactgaggacagcactttacagtaggtcacatccctaaaggttagacaaacatgagtcctaccgaattgtgtaggtcacaagcattctaaagtacaaagaagtagtacattttgcaaggcagaaaaagtgttgctcctcttctaatctgagatcaacagacagatcaagagagctcaccttgtctcccttcttgctctgtgggactgctaggaacgataaaaggagtagatcggaaagcatcaggagaaggagcaacaagatctgaagaattcctttatataaagagagaatcacaggttattttaccatagccacagttttgcatttctgtatttgcttttactttttaacaggaaaaaatatctaaggcattcagataaatacttatcagcacttttccccaacagcaacctgaggctggtggaagaaccaaaaatacttcaataactatttcccacaccagacatttctgttgtaaaataagaactttttcaaaaagagagtaagggcaaagtgaatgatcagacacaaggacatcatgatttaaaagcaaaatgagcagtgctaggaaataaattcatttgcagatttgagacataaaaaaaattattccatttttttgcctaataatagtcagaccatgaacattttcatcagaaaactaaaactaaacaaaaaaaaccaacaagcgaacctctttgccctaacataaagaaatccaactactgtcaacttaacaacctattctccaccctctgctattaaatgagaagaattgcaagtaaaacagaggagcagaatgcttgttttggatgtgtaacattttctaaataactgcgccttttctttcttagtgaaacgtttgggctactattataaaattttcaaatgggacaacagatttatctgccttcaacagttcttcatccccaaagctctaatgcataggttctaccatttggtttcaaaaagaattctagactagcagataagtttagcctctttcagccttagcctaagactctcaggcacatactgccttggcataagctattttaggcttacttacgtggaaagactgtcctgaacaagggacctctgaccagagagctgcaggagatgcagagtggtggcaggagtggaagccaaagaacacccaccttcctcccttgaaggagtagagcaaccatcagaagatactgaaaaaaagaaattccagttgcacttctcagattgacactactgagctgccaaaaaccattcagtactgcaaagagtaatatccatatttccaacatatttccatatttccaaaagggcagaaattgttttctaattatagtacaacgaatggactactacaatagcacaaatcttgagtgaacattaaccacccccgcaatgggcttcttgaataaagaactgatgaagagttccttagtcctttctgtcatgatctaagcttggagattaaaagccagaatcctggatgggcgcagtggctcacacctgtaatcctagcactttgggaggctgaggcgggtggatcatctgaggtcaggagttcaagactagccagaccaacatggtgaaacctcatctctactaaaaatacaaaaattagctgggcgtggtggtatgcgcctgtaatcccagctacttggaaggctaaggcaggagcatcacttgaacctgctaggcagaggttgcagtgagctgagattgcaccactgcactccagcctgggcaacagagggagactccgtctcaaaaaaataaataaataaataaaataaaagccagaatccttatacttctgcttagctgctcttctttcttgtgatgcttctattaaaaaacagcaaatgagccttttattccaacgtctaccttaggtgaagtcaagctcatgccatgatacagatgggagaagtcaaaaaaatgcacatgacacttgatgttataaatgcagcagttttcaagatttgggcctgctcaaaggagtaaaaggatttatgagcagccattactgttttatactatgaagagtctcttgttggtcccttccccttagcaatagatggagtatcaactatattaatcccagtgtaaaagaatttcttaaataaaaccttacaactttagtaagagaccaacaaaggttcctcggtgaccctctgaatgtcttgcacagcaacctgtatcacagcatagcaaaggaagatagccttcttcccttcccgccttacaaccaacataatatgttttgctggtaattaactcaagctttctagctctctgaggctgtggaatgaaagattggtggaggttaaagaggtgtgaaacaaattatatccttttaagttttatgtcctttccgctagattttaaattcctatctgtgtcagattaactaataaacagattaagttagtaaactgttacccagatgaatatgaaaaacctaggcttaatatcatattgaagatttgaagacatagtagccatgtaacagaaaatggcagccaggtgtggtgactcatgcctgtaagcccagcactgtgggaggccaaggcaggcggatcacaaggtcaggagatcaagaccatcatggctaacacagtgaaaccccatctctactaaaaatacaaaaaattagccaagcatggtggcgggtgcctgtagtcccagctactagggaggctgaggcaggagaatggcatgatcccgggaggcggagcttgcagtgagccgagattgcgccactgcactccagcctgggtgacagagtgagactccatctcaaaaaaaaaaaaaagaaaaaaagaaaatggctagtatccataatactaaatttactgtattagctattcttcaccatctcatttccaaaagagagaaaattatgtcaaaatattaaatggaaattattcccaaaaagcccttctcactaattactagaaacacgttttccttccatatcacaaacaagtctgcaaacctataaaatgctttgtaacttaaccagtagcctcagaactaaagtaaaagtttagatctttggagaagagctgtaacgacaaatcactcttggtacctgttttattgctctggtcaaacaagtcttcctgagttgacaaaacctcaggctctggtgacttctgaatctgcagtccactttccataagttcttgtgcagacaactgttcttttgcttccatagcagcaacagatgctttggggctaaaaggcatgtcctctgacctaggaaattcatatcaccaggagaaaaagttcctaagttcaaatgtttttaaataaaaagcttttcctgttttgtgtgtttttctttaataatttcaaaaattccagtggctctaatttacataattatatattaaaaaggaaataaactactctttatagtgataaaagtcctcagcccattttaaaacctgtctcactctctctcacagccaatacctgtcttcaactctgctcaatactgtgcttcatgctttctaagatttctgatgagtaacttggggaatttttgttacatataatgttatctagacctgtataaagaattctgatccagaccccaatgatgccagtaaggagaacagtccaaaccatgacattccatggaaagcatttgatgtcaattatcctccttactagtgccacacacatcttctgctgaccttttccatttgatgtacccaaaccccaaaccaattctccttcagatcaatactaacatgtataagacattcatccctggcccctttccagagacttatgaggttcacctgttctaccactccccagggtaaacagaatagcataactagatggaaggcagcatctaaaagaaaagcctaaaaagtcactgttatgctgagtgttttacattagaaagacaatttctcttgatattcaactttgcttaggacactctctccccactctttccattgaaggaaataacaaaacaatactgtttatttatcccctatcccaaactggaagcatcccagttttcttctgccatattcaaacttcacttactggccagaggtaatgaagctttggttataaaaatcacgagagatgaagcagaggcacattccccaattcctaccaagttaagagcctaaagaacctgagaaaatccctacatctatcgataccataaaataccagatgcaggatacctaagaacccaaagcaatctgggtgctcctcaagtatagaaacagtaggctttcaaataaaatagtcatgttactcttcataacaccagagaggctaagaagacctcccacagacaagcagtgtctctgtagacaaagatcacaaaggaggagtggcaaccaaagattacggagtcatgcttatagttagagcagccttaaaacatcattgcaggctaggcagagtggctcacgcctataatcccagcactttgggaagctgaggcaggaggattacttgagcccaggagttcgagaccagcttgagcaacatagcgagactccatttctacaacaaaaaaatttttttaatcaacaaaaaaaggtctttgtagaatgcctaaagataagattagtagtcaagtgtggccccagtacttgggaggctggggcagagaatcacatgagcccagggcaacatagtgagactttgtttcaaacagacagacagacagacagacaaaaaacaattcttgagacttcataaataatcaacgtttccaatggaccacaagtatgcccagtacaaggggaaaataatttaaaaatcaacaatttctaaaaatgttttcatctggtaaaatgacattagtataaccctacagcaaaactcgtaaatcctttttagaaagttcggcttaccttgcaggtggtggattttgctcttttacaacatgtacatccttactgggctgtgctgtcacagggatgtccttgctggactgttctgctatggggatatcttcgttggactgttcttcatgcttaattgctgagagttttataaaatgacaggaaggagataattaagttttcaaaatactagatacagtcccagatgttttttaaaaagcaaagattttaacagaagtccaatttaaaatatatacaggcatcagtctataaaggaaagtaaccaataacttaaaacctcagcccacaaaccaacaattgacaagtatttaccagaaaactcttcaaccttactaaattacttagattatattaatttggatagctgcaaaacttatcaaagaaaaaataactacctctaatatgggagaaaacacaacaactccaaatgccagaaaacatgtttcataccagtattagcatccacatcagacagcctggtataaccagagttggtggttactgattgtagctgctctttgtccacttcatatggcacagtattttcctcaacatcctggctctgggagagttccagaaccccaaaacccaactgtgatgaggcagtatctaggaacaaaatgccaagaaattaggtatcatcccacaacattatgcaatgtacaagctgctgtcctcagcaaaggagggtcccgttaagtccttcacatcaaagccctgtgcaccccccaaatttttcaaaaataaaaaataaatgtggccgagcacggtggctcacacctataatcccggcatttgggaggccaaggtaggtgaatcacttgaggtcaggcggtcaagaccagcctggccaacatggtgaaaccccatctctactaaaaatacaaaaattagccaggtgtggtggcgcacacatgtaatcctggctactcgggaggctgaagcacaagaatggcttgaacccaggaggcggagcttgcagtgagccaagattgcgccactgcactctaacctgggcaacagagcaagactccgtcgcaaaaaaataaaaaataaatttaaaaaaaataagtgcattaaagatgaagggggaaaatgtgtaataaagtaaaaatacttcatactataaaatcttataaggagactacgtctgctttctaaaggtacatcataaactacacccacagtcacagcaattcagactgtacttacaccccacaaagtacacattacaaaaatatttgaaaaacaaatgaatacaagaggaagaaaactcaatatgcagaaaggggctaaccaatgaactacaaattcctgaataccaaatcaggtggaacattttaaattactagcaaatttcttaatgactctcaatttaattatgagaaatctgcaacctaataaagaggagaaatttagacatctgcacaatcatgttaaagggaagttagaacagtctattattctgaaaaaagcacaaggctaccttcagcaccaagggaatgtgtagtattgcctgaagtatcttcttccttctctttctccttctgttccaactcttctcccttctcttcctccacagcaggagcagattccactgacattcccagaacactacacagcagaaggatataatcatgtgttcccagatagtttgggacactttaatcagagcactctgacccccaacacataccaaccatctcttagccaaacttgaaaaagtaaaatacctcacctttatagtgcttctttctacaaaaagcacctaaaagattaacaattcaacatcctacacagaattaagtaaagaaaaaataaggcaccaacatactcgaattttatatttttgagaagaggcagaaaaatcttgcattcaggagaattactgacaagtgacaagagaagatatgcattggatgagcacagaaagggctcaaaaaactttttaaaagttcacagaagtattttagtaaaaaatcttaaaatacatatatagaaccacagagtccaaacaaaattcaggtaaggagcttatatatgtatataaatacacacacacacacacacacacacacacacactttttattttttacttattttttttttaagagacagagtctgggccgggcacagtggctcacacctgtaatcccagcactttgggaggcagaggcaggcaggtcacgaggtcaagagatcgagaccatcctggctaacatggtgaaaccccgtctctactaaaaatataaaaattagctgggtgtggtggcatgcgcctgtagtcccatctactcaggaggctgaggcaggaaaattgctcgaacccaggaggcggaggttgcagtgagccgagatcgcgccactgcactgcagcctggtgacagagcgagactctgtctcaaaaaaaaaaaaaaaagagagagacagagtctgtctcccaggctaaagtgcagtagcacgatcacagcttactgcagccttgaactactgggcacaagcaaactccatatatttttaaaataagttaacaccgaccaggcacggtggctcacgcctgtaatcccagcactttgggaggccaaggagggcgcatcacgagatcaggagatcgagaccatcctggctaacatggtgaaaccccatctctactaaaaaatacaaaaaaattagctgggcgtggtggcaggtgcctgtagtcccagctactcaggaggctgaggcagtagaatggcgtgaacccgggaggcagagcttgcagtgagccgagatcgcgccactgcactccagcctgggcgacagagcgagactccacctcaaaaaacaacaacaacaacaacaacaacaacaagaaacaacctataaattcagcattaaggaaatgattacataatttcacaatctattaataacatatatcaccgttaaaaatgtttgaaacaaggccaggcgcaggggcttatccctgtaatcccagcacttcgggaggccgaagtgggcggatcatttaaggttagttcaaaaccagcacggccaacatggtgcaaccccgtctctactaaaaatacaaaaattaggctgggcgcggtggctcatgcctgtaatcccagcactttgggaggccgaaacaggcggatcacaaggtcaggagatcgagaccatcccggcgaacaaggtgaaaccctgtctctactaaaaatacaaaaaattagccgggcgtggtggcacgcacctgtagtcccagctactggggaggctgaggcaggagaattgcttgaacctgggaatcggaggttgcagtgagccaagatcacgctactgcactccagcctgggagacatggcgagactccgtctcaaaaaaaaaaaaatttaaccagtgtggtgtcatgtgcctgtagtcccagctacttgggaggctgaagcaggagaatcgcttgaacccaggaggtggaggttgcagtaagccgagactgccccactgcactccagcctgggcaacagaaaaagagtctgtctccaaaaaaagaaaagtgtgaaacaatcaaatacaaaatgtgaacctgaattggatcttagatgctatcaaccaaccaatcaataaaacaagacaaaagacatctttgagacaactgggaaaatctgaactgtatacttaaatattatggaattattactttaagtgtgataacggtactatgattatatagaataatgtacttattcttaggggatgaatgctgaagtatttaaggggacattatattaaggaaaaatctgatgtctgcaacttaaacaattaatcctccccaaaaaagtacagaacacacacacacacacacacacacacacacacacacacagaacaaatgtatactctttcatttcttctgtgggcttaaacttttaaaataaaaaacttggggaatatgttaagttttaattgtcatgagaaaaattttcatgtttttaagcaaaacatcagcaaacatacacttttactttccacatgatgtcaaccatataaatcaaatgaacaaaaaaagagagaaaagatgccaaaatgtttacagcaattagcctctgggtggcaggattacagatgacatctttgcttccttgcaactttctacacaactaatatttcataaaaagagcattaagcgtaactgtaataaacacaaaagaggtgaaaatataaatttgcaaagttgggaaccgtgacccaagcaagtgaaagaagactaagtaaagatttttacaaaagcaaaatagaacattatctatataactggaaggaccagataaatgactttgggaaacagagggaaagaaagttcaagagcaaatattgcaaatggtagaaaagaagcaatgaaggacgacagcacaaaacaacacactttgagctcttcttagtttcttttggtgtttttacctcatgtccctgatctctaaatgctggtaggctccgtgagtccttggacctcttttctagctacattcacccacttaatgacctcatccagactcatggtttagaatactacctatctgcttatgagtctgcaatttaaatctctggcctagacttttccctctgagctccaggcctccttgtccaattacctcctcaacacatccagctggttgttgaaaagatagcacaatgtttcatatgtttaaaactgaacttcccctcctgcagtcttctctatcttaactgtcattccattactctagttgctcaaatcaaaaacttggaatctgccaggcacggtggcatacatctgtagtcccagctacttgaagcaaaacaaacctggaataattattacttccttcttgtctctcacactccacatctgatctgtctttgaatccccttttcaaatactcagaatctcaccattcttcatctgcttcaatcctggtccagccactatcaccttttgctaaattatgtcaatagtttccttgttggtcttcctgcctctagccttgtcctgctttcagtctattcttaatcaagcagccagagtgactctgttaaaaatctaaatcagatcatgtccttcccctgctcaaaacccttaaatgtcttcctatctcactaaaaataagagccaaattcctcacaatgccttacataatctggttcccttctgacttctctgacctcttctctcacttctcttagtcactccactacagccacactaacctccctgctatttctcaaatattccagggacgctcatgcctcagggtctttgaacttgccattctccatgcatggattacacttatcccagataacagcaaatacacacttacttgttttttgttttttttttttaagatatggtctcactctgttacacaagctagagtgcagtgaagcaatcatggctcactgcagtctcaacctcccaggctcaagcgatcctcccacctcagcctcccatgtagctgggatcacaggcgcacactaccatgcctggcttactgtgtattttttgtagagacagggtctcactatgttgtccaggctgctctcaaactcctgggctcaagagatcctcctgcctcggcctcacttagatttttaatcaaatgtcctatcaatgaagcactccctagacaccctatgtaaacttgcaaccactttgttgcttcctctccccttccctgctatatttatctcttcagcccttatcagcatctaacatactacatattttacttatttatcatatattgctataccctacacaagaatgtaagctacattaaggtctaggatttttatttcttctgatcactttgtatccccaaaatccaagaacacctggcacacagaaaatactcaatagaaggtactttggccgggcacggtggcgcatgcctgtaatcccagcactttgggaggctgaggcgggcggatcacgaggtcaggagatcaagaccatcctggctaacatggtgaaaccccatctccactaaaaatacaaaaaattagccaggcgtggtagcaggtgcctgtagtcccagctacttgggaggctgaggcaggagaatgacgtgaacccaggaggcggagcttgcagtgagccgagatcgtgccactgcactccagcctgggcaacagagcgagacgccgtctcaaaaaaaaaaaaagaaagtactttgggaggccgagatgggcagatcacttgaggtcaggagttcaagaccagcctggccaacaaggtgaaaccctgtctctactaaaaatacaaaaattagccaggcatggtggcacttgcctgtaatcccagctactcaggaggctgagggacaaggatcgcttgaactcaggaggtggaagttgcagtgagccaagatggtggtgccactgcgctccagcctgggcaacaaagcaagactccgtttcaaaaaagaaaaaagaaaatactcaaaaaaatttgtagaatgattagacaaatcagaaaaagcatgaaataattcagattacagacaaaaaacagtactttagttaaacttttctccactgtctaaagttgatggaaagagaaaacaaaggtttaaatatattatttagaagtgtaaacggagccagaagaattaaaataattaccatcaaaaattgagagggtgaaaacaaacaaaaaaaaaattgggagggccgcggaggtgcctcacgcccgtaatcccagcagtttgggaggctgaggggggtggatcacctgaggtcgggagttcaagaccagcctgacgaacatggagaaaccctatctccactaaaaatacaaaattagccgggcatggtggcacatgcctgtaatcccagctacttgggaggctgaggcaggagaatcgcttgaacccaggaggcggaggttgccgtgagccaagatcatgccattgcactctgcctgggcaacaagagcgaaactcggtctcaaaataaaacaaacaaataaacaaaaattgggagggtgttgctgagttaccccatctttcattatcagaactcaattgtattactttacatataaaacacatttatagttttacaatagtattagaggtaggaagataacctcccaaagaagtaaaaccataaacagttaaagagagttgcctttgtgaaaagggagcaagggtgaggaaggactctctgcttttcattataagccctttttactattatttatttatttgtttttgaggcagggtctcactctgccacccaggctagagtgcagcggtgcaatcacggctcgctgcaacctctgcttcccaggcttaagcgatcctcccacctcagcctcctgagtagctggaaccacagatgtgtgccaccatgcccagctaatttttttgtatttttggtaaagacgggatttcaccatactgcccaggctggtctcaaactcctgagctcaagtgatccacccgccttggcctcccaaagtgctgaaattataggcctgagccactgcacccggcctataagccctttttaaagtaaatgacttatattattctgttaaaaatatttaacagctctcaccaaaattaaaaattgctccgtgaaaaaccctatgaagagaaagaaaggatagagtgggagaaaatatttgcaaaatacatattctacaaaagactagtatctagaatatataaagaactctcaaaacacaatagtaaaaagacaatccaattagaaaatggacaaaagatatgaaaagacatttccctgaagaaaatgacaggcagcaagtaagcacatgaaaaaatcctcaccatcattagccattagggaaatgcaaactgaaacaacaatgaggtatcactacagacttgtaatggctaaaataaaaaatactgaaaacaccaaatgccagtaaggatgaaaaaaaattagatcactcatacattgctggtgggactataaaacagtacggccactctagaaaagtttggcagtttcttaaaaaaacaaacatgcaactaccatgacccagcaattgcaaatctgggcatttatcctagagaaatgaagacttatgctcacagaaaaacctgtacatatggccgggcacagtgactcacacctataatctcagcactttgggaggctgaggcaggcagatcacctgaggtcaggagttcaaaaccagtctgatcaacatggtgaaatcccgcctctactaaaaatacaaaaattagccaggcgtgatggtgcacggctgtagtcccagctactcaggatgctgaggctgaagaatcacttaaaccctggagtggaggttgcagtgagctgagattgcattccagcctgggcgacagagcaagactccatctcaaaaaaaaaaaaaaagaaaagaaaaacctgttcataaatgcttataacagcttctcaatagtagtcaaaaacaagaaaaaaaaatgcagatgtccttcaacagatgaatggttaaacaaactgtggtacatccacggcatggaagactactcagcaataaaaatgaactattgatacatgcaaaaacatggatggagccccagaagttatgctgattgaaaaagccaatcccaaggatgggcatggtggctcatgcctgtaaccctgcattctaggaggatgagacaggaggattgcttgagcccaggcattggagaccaccctggccaatacagcaaaaccccatctctacaaaaagttaaaaaattagttgggtgtggtggcatgtgcctgtcgtctcagctacttgcgaggctgagatgggaggattgcttgagcccaggaggtggaggctgcactaaccatgaccttgccactgcactccagcctgagcaacagagtgaggccctgtctcaaaaaaaaaaaaaagccaatcactaaaggttacagactgtatgatcccattttatatagtattttgaaatgacattttacacatgaagaatggattaatggctgccaggggtttgggtgcaaaagacggaggtaggtgtggctataaaagggcaacaataaacatccttgcagtgttagaactgtatcttgactgttgtggtgaagacacaaacctacgcaggtgataaaactatgtaaaacttaatacacacacgcatacacacacacataaaaagaagtaaaacaggaaatgtgaataaatttggtggatttggccaggcaaggtggttcacacctgtaatcccagcactttgggagactgaggcaagtggatcacttgaggtcaagagtttaagaccagcctggccaacatggggaaaccccatctctactaaaaatacaaacattagccagcagtggtggtggacacctgtaatcccagctactcaggaggctgaggcaagagaatcgcttgaacctgggaggcagaggttgcagtgagccaagatcacaccattgcactccagcctggggaacaagagtgggactccgtctcaaaaaaaaaagtgttttgaagagatttcattcttttggaatcaactccaaattctttccagcttcatggcctatgcacacacagttcattctgtttggacagctcctcctttcatactgcacatagaaatgtgcagctcttcaactatgccctccaagcccttcaactatgcctaacaaattcatatttattgtttagattgtattccacaaagaggtgtccccttatccttctgattacgttatatatattttttctcctctttgcaatgatcacagttgtaatggaatagctactgatgtaatgactcatttaacatctgtctctcctattaaattataagctccacaatggcaaaagcccctttaaagcacatgccacagtgcctgcacatttatttaacatgaaaagaagtagcatgaaacttctcaaatagcattgcttcattcacaatgagggacgtgcatacttcctgtccccactggctcaaaccaggatgctgagccacaaaaacatagataagcctggcacatgttcttaaagaggtaccataaacttaaatgcccacagaaatcaaagcaagataacatagatgagtgaagcagctgggtgtaagaacaaaagcacaagcactatgataaatgacaaaagaacacctggcctcagtgtccaagtacaataatgaattgtagtgactatggcaaatcatagcactaatgctccatctaagcagaggctgactgctactcataactccagccaactgttgccaacagaaacaagaaatgccagaagctggaagtctaagttttatgagaaatttccccattctaaaattctgtcaattaattcaaatatattaacattttaccacctatgtaggccaaataaaacacttctgcaggccacaatgagcccatcggtttgcaggttgttctaaagcatttattttacttgatgatttgtgagaaaaaaaaaattacgtacagacacagagtgtaaaataaaacacacctccaaaaaagcttttctttttgagacagggtctcactctatcaaccaggctggagtgcagcggcacaatcacggctgactgcagcctcaatcttccaggctcaagtgatccttctatctcagtctcctgaatagctggggctacaggcacggaccaccatgccctgctatttttttttttattattttattttattttgagacagagtctcgctctgtcacccaggctagagtgcagtggcacaatttcggctcactgcaacctctgcttcccaggttcaagtgattctcctgatgcagcctcctgagtggctggtattacaggtacccgctaccacacctcgttaatttttgtatttttaagagaccgggtttcaccacgttgtccagactggtatcaaactcctgacctcaggtgatccgcccacctcagcctcccgaagtgctgggattacaggtgtgagctaccacacccagtcctttttttttttcttttgtagagacagggtctcactaggttgcccaggctgatctcaaactcctgggctcaagtgatcctcttgtctgagcctcctaaagtgctgggattacaggtgtgagccactgcgcccagccaaaaaccatttctttttaagaaaaaacaatagtctttaaccatctcaagctaacattctcctctctaaccacctcccctttctaccaccccaaaactcctgaagttctctacattctccttggaccttagaaatattggggcggaagactgagaagcactgattagttagaatgaaagaggaggcattagagtcattaggaccaggttcaaagccagctctgccacttactagcaatgtactctaaagcaagttatctaatttctttgtccatcaattttcccgtctatacaatggaagtaatgtaatgtcttcatcgtacagctgctttaagaataggattaaataacattatactatatgccaaacgtccaatacaggacctaacacagagcatgaactcaaaaaatgggtattataaagatatgcaaaagacatggtaacaattgaatcttgtttagggtaagaattaaacattctagatctaaaactggtggggtacttcagttgatagatggaaaacatgcctaatagttctgataatactcctaaattttttttttttttttgctgagacggagtctcactctgtcactcaggctagataaagtacactggtacaatctcagctcactgcaacctccgcctcccaggttcaagcaactctcctgcctcagcctcctgaatagctgggattacaggcacgcaccaccaggcccagctaatttttctgtttttagtagagatggggtttcaccatgttggccaggctggtctcaaactcctgacctcaagtgatccatccgcctcagcctctcaaagcgctgggattacaggcatgagccaccatgcctggcccctaaatactttttaataatttttttctactaggaggaatgcttattttgtttcacatgcacaagacagatcatgatttgaataatgtaggtataaaaattattaccttcacaaaacagtttccagctatcagtactattacaatactatctaatacaaccctcaagtcccatttcctaatccacaagaaagagattaatccttttatccttgggatgaggcaacaggtacagataaaagaacaaatctgataatacatttaaataaaccccttcaaacactgtatacctgcttgtcctgtttggctgaggtaactgctcaatgacctgactgatggaaccacatgtgtccaagttagaagaatccacagggtctgaaaaaaataactggatattagcatgaaagacatttaccaacaaaccttaatacaaaatcaggaatacagacaataccaatctaatcagtgacactagcacatcaacttttgagtgactactacgcagataccacagtaggcttccttacatacattcgacacaaccacataaagtttaaatccacccagcaccaacaagagcacccaaaaaatgcaaaggggacagatagctttaaacacctcacctgcaaccttgttttctttcaaatgttcattgaacccactattaccgtctcctcgttcttctccagctgtttgttcaggattggacacaacatcctagaaaatacacatacaaaatatccccattatatatgaaatagttcaaaatgaaacctactatttgtgaacaatttttccaatcaactttattgagaaggtaatgatcttctaaatacttatgtttgctggttttcggtttaaaaaaaaaaatctgctcaatcttcttcaaacaaggtatcactcaccaacacaggattttctttgtgcgtctggagattaggaaggtgtcgagatagcatactgaagtgagaaccagaatcatcctctagaacctggctttcaggctgagaatcttcaattatcaggcaaggagtatcttgctgagagaaatctgaatccaactgacttccagtagggtccatctgctcccctggaatggaataacaaaagatcagttccgtgtaacctactagccttgctcacgcagtctaaacctaaataatggggcggaagtacaagagctgggaaacgggaccacttcaggactcctccaattagaatattatatttataattgctgcaagcactttcctatcatgcctaccaagtcaccattcctcgttatttacaataagcctgactatccctccctatttttcatcaccttctcgtagacaccctttcccctccttcctaacctcttctctccccgcccctttttccatcccccccgccacgtccttctggcgcctctacctccccccaaaagaatgttttctaaaatctgttcgccagaggccccacagcctttcagctttcctcacgaccaccaagccttcttagctaacgtttccccaccccctccttagggccctccaaccccttccccgtcaccgccgccatgcttgccaccccgccccctccggtcagccatcccttcagacccgaaatccaggccttcagagcccactgcactcccatttctctccaaacagtaccaggcatcccggcgggaggtccctcgcgctcgagctagaggtctctgcacgctccccaagtccctccagatcgatccctaggtcgccgctgtcgccaccgccgccaccggccgcgaactccccctttcccgtcacgtcacacaatatcggatcgtccattcgctgccgccgcccgccactcaagaaatcccgtggatgataggtagctgcggcagagtgccctgccccacgtaagaaaaaggaacacggcggcgcgtttccatggcagcatggacgttgcaggccctcccctttagtagagccggagaatgacggtatccttgaaccgaagggaccttgagagggcgtgaaataccttcccctgcttccaggacgattgcatttaccactactcagacatttcagtacctctacctgctttttctcgttcacgccccttaatccccgtccctcaccctctttcctggaaaaggagagagtttcccagctttctcataacagggcaaagaagaagcggcttgaggatggctaggtacttcagagctggtgaacccaacagaagagactctttcttctttgacacagggttaacctgtgtcaatcaggatcccttttgtgggcctctaccctgaatccaagggcctgacattacatctctgccagggcgtttttagtatttgtttgtttttacattgtataagggctccagtaagccatatttcttcccattgcccttttccgcctaggacgtatttcaagcttcacacttgtttatcgttgccttatcttttatgggattgcctgcagagactacagccccagacatattttgcacctcccattgagagaattgagcactgtcattctcaaactccatggtaaagagaacagctgccaccccttctaactagatgacctcaaagatacttccaaacccagagattctattatcctaattatggtgccagggtcttaaagagggtgtggcagctgtgacgagtcttaatgaactaagccccatgtggcatatgtgtttgttttgttgttgttgttgttgaggggtgggggtatattatttaagtggcagttggatccaggatagaattctagccagagcagctgtcaatagggaaagcacctagcacagtgccaaacatatacatagtaggcattcaatatgaggcagttttctctttctaccccaggctcagatttatttcggcacagcccaaccatgattctccatttctgtaaatgcccaattcagcacgtgatataggcaaagctgaagtggagcttcctaccagtcttctcactgctgctataaattacagtgatcctattttccaaaccaaattcaaagcatgttgtctgaatacacgttacttatgggaacaaaaggactgactccttgaaactgtcctgaaaaatctagaatctattactgctataactggaatataattatggtcgccagtatgttttattagtggagctaaaatgaaatggaccacacagagatgcatctcacttcttaatcttaaaatcatttataattgactcttttcatactccactcctaaagctgcagaacaccagtgactaaacaaatctaatacttaaagaccaggttagagcaatactaactacactagctggacaaagtgagttcatctgctctatttgagagggcacaaccaaccaggtcctgttatgagtaaatcatgaccttgagtcccataaaaatcccccaaaagttaccatttttttgcttttcttctccagcctgcttctgcttcctccccaagtgaggcacaaataaacagatctgtttgattacttgacaagtgtgtttgtcgaaacataaaatggctgggcgcagtggcttacacctgtaatcccagcactttgggaggcagaggcaggtggattacttgagcccaggaatttgagaccagcctgggcaacatggcaaaagcccatctctaaaaaatatacgaaaaaaattagctgggtgtggtggcatgtgcctgtagtcccagctactcaggaggctgaggtgagagcatctcctgaactaggaggcacaggttgcaatgagccaagattgcaacactgtgctccagcctgggcaagagagtgagaccctgtctgaaacaacaacaataaaaacctaaaaaccgccaggcgcagtggctcacacctgtaatcccagcactttgggaggacgaggcgggcggatcatgaggtcaggagatcgagaccatcctggctaagatagtgaaaccccgcctctactaaaaatacaaaaaatcagctgggcatggtggtgggcgcctgtagtcccagctactcaggaggctgaggcaggagaattgcttgaaccctggaggcgtaggttacagtgagccgagatcgtgccactgcactccagcgtgggcagcagagtgagactccgtcacacacacacacacacacacacacacacacacacacaaaagccaggtgcggtagctcacgcctgtaatcccagcactctgggaggccaagtcgggcagatcacgaggtcaggagatcgagaccatcctggctaacacggtgaaacacggtctctactaaaaatacaaaaaattagccgggtgcgcgggcaggcgcctgtagtcccagctacttgggaggctgaggcaggagaatggcgtgaacccgggaggcggagcttgcagtcagcagagatcgcgccactgcactccagcctgggtgacagagtgagaccccgtctcaaaaaaaaaaaaaaagcctaaaaacctcagcctgactaaaaatagataaataaatgagtgagccatttgcattactaaacaagaatcttaaaaaaaactgttaagaaaaactattaattccttgttaggcagtgtggcaattaaattaatcattaaattatccagaaaaataaactacaggcagaatggttgcagctagatgagccaaaggcctttattgactcctagactgcaaaggaccaacagcacatctacctgtctacaggtaacatcttttcctaaaccaccttagacagagaaatctaacttacctctaaagccctcccagagaaggctcatcagatcttaggttaacttgctttaaagtttaacaaacctcattgtcagaaatttttcttctaatattaatcttctaatcttctaacctaaatcctttattatagaatttaaagccatttcctctcatattgtctttaactgctatctttaaaacctagatagatgtcattaagttgggatcatctcatttggtcctataattatataataaatttcaaaccatcaaacaacaaatctaaatactatatgacttagtttgtgagtatttttctgaagcctcctcaaagacttcttaagcaaaagaaccctagcccagcttattcttccctcacaggtattccaccaacctttaaagttgcttcacgatcttatgaaaactcatagttttggagctcagtggcagagtactctactgaggagaattgacaagtgccaaatttaatgataggaaaacaatcatatattccttttttttttttttttttgagatggagtttcactctttttgcccaggctggagtgcaatggtgtgatctccgcttacggcaacccctgcctcctgggttcaactgattctcctgcctcagcctcctgagtagctaggattacaggcatgtgcaacacacctggctaattttgtatttttagtagagacagagtttctccatgttggtcaagcaggtctcgaactccggcctcaggtgatccgcccacctcagcctcccaaagtgctgggattacaggcatgagccatagtgcccagcctctcccctctttgtatagaagtaatcaaatcttcacatccaagtatcatctcctgtccactctacttctctacgtttgcagtctggcttcaacctccataaatctaatgcctagcacaatgccagacacaaagtagttactctaaacatgttaatgactgattctaaaattttcttgtcaaattacctcattatcagccaggtgcggtagctcaagtaatcccagtactttgggaggccaaggcaggctgattgcttgagctcaggagttcaagactagcctggccagcatggtgaaaccccgtctctattaaaaatacaatggtggtgtgcacctgtattcccagctactcaggaggctgaggtggaagaatcacttgaacctgggaggcagaggttgcagtgagccgagatcgcaccactgcaccccagcctgggctacagagtgagactctgcctcaaaaaacaacaacaaattacctcattatctttgacgtctgtagtgtctgatgctgttgccattccctcctcaaaattctcatcctgtgactcgataaatcctggctcttctctaccatctcagctttctttccaattcctaacttcctggaagccagtactatagaataaaaatcgagagtgatatgaacatgctcaacacagatgaaccttgaaaacattatgctaagtgaaataagccagacacaaaagaacaaatattgtgtgattccacttatacgaggtacctagagtaggcaaattcagaaagagagaaagtagaatggtggctgccaggagctaggaggagggaggaaagggaatttattgtttaatgatttacatagcttcagtttgggaagatgaaaaagttctggagatggatggtggtgatggttgcacaacaatgtaaatgtacttaatgccactgaaccatacacttaaaaatggttataatggtacatttatgttatgtgtattttactacagtaacaaaagtttttcaatgagactaaactttaatatttaaagatgtgtacttagatcataaaaaattttaataacaggattgcaataaaagaatgtatggttaattgtataggtaacagtggggttgtaattcattaagaggcatgtgaggtgcttggaaatgttctattttttattaccagaggcattacacaggtatactatttataattcataaatttgtacatttatattttattttattcactttatgtgtgctatgtttcacaataaagatgattcaaaataaatatcattaatgctaaaactcataatatggtgaaagagggtatatacatgatctcaaagtatctccctaaaatgtactgaattattacaaagagaaaagtggtaaatttgcagtgaagaaacctggtattcaccaactcaaccaagtgatctcagttaatataccagtaagggaacaaaaagccatctgtgtcacttgatataatgcactgaggatatatcacactttaattgtattcttgccaaaaatctataacctgaatctgatcatgagaaaaaatcagataaatccacattaatgggtgctttacagataaacagcccatattctccaaagagaaagagagagagagagaaagaagtgctgccaaggtcaagaatgacaatcaaagtctcaagaaatgttctagatttgagaagactacaaagacaaaaccattaaatgtaacagatgatccagaactgaatcctggacaagaacttggtttcccttcttctataaataattctaatgggagcactgttgatatctgaataaggtctgtagattagtaacgaatcaatgttattttcctgatcttgataattatactctggttattaaataaaaaataaagaaagagaatggtaccaaattatccaagattggagctgggcagtttggtactaagcaaaactaaagaaaagttaacctgcacctgacataggaacagcatgaggacaagagaaggaatatacttagagactatggaaactgccagaaatcagacccaggatggtagaaggtgagaaaagttcattttgcaaattaaaaacaacaacaacaaaaaaaaaaaaacaaaacaaaccagttactcctaaactcttatgtttcaatggaaagaagggagtttttatgtcctggggctgagaaatctaaaaagaatataagagaagacttcagtggacaaggacaccactgtgtcctagtggctgagctgtgaaatagttactcatattctgaggtagtgtgtgtacataaagtaacgtctacgtacaaagaagggaacaacagactctggggcctacttaagggtggagagggggaggaggatgagaatcaaaaactatcagttactatgcttgttacctgtgtggcaaaataatctgtacaccaaaccccgtgataatgcaacttacctatttaacaaacctgcacatgtacccctgaacctcaaataaaatttaaaaaataataataaataataaagtaaaagtaacatagcatgaacacagtgcctactcttggatcctacttcctgtgtcattattacactttcccattctactctgagcatatcccttctgcagtgtcttcagtacagctaggtctcaaaggctgatctggacttgtacagagctagtgtgctaactaacaagtggcaagaatagcagtaatgcatcttggctctactcacatataagcacatcacacagagtctcaagaactgaaagtcagagcaagtcagaaaacccataaaactgaccaaaaatttcttcacaaactcaggttcatttattaatttcaattcacttaaatgcaaggtaccattttggctccatggtggtggtggagagagagcagtgtataaggatgagtaatatctagtttctagcttcaaagaatttacaatctaggaaggagataagacatagaaataatgatagtacaagatacaataaaagttctgtaggaattgtgagacaaatcgaaataattttagtcatgtggttataatgaatacttcttgagcacttactatgttctaagttctatttactctcactcctttcttgatttcatccagtcacattgctataaatacaatctatatgccaatgactcctaactacgtctttgacccacacctctctcccaaattaccaatttatgtatctaactgcctattcaatatcttcattttgatgtccaattgacatctcaaattcaacatgcttaaaattgaactcatctcttctaccaagtctactccacctgcagccttccccatctcagttgatggcaacttcacccttctggttgcttataacaaaaagcttgaagatactgtctttttattaacagaaaaaattttaaaagctatgtacttatataatacaccttcaacaattagcaacaaatgctcaatcttcttttgttgaaatttttttttttcaaacaaatgctcaatcttatttcatctatatccacccacttcccccaaactgatttctaaacaaatcccagacatcatataattttaaccaaaatacttctgtgtctaaaatatagagaatattttaggccaggcttggtggctcacacttaaaatcccagcactttgggaggctgaggtgggtggaccacctgaggtcagaagtttaagaccagcctggccaacatggtgaaaccccatccctattaaaaaatacaaaaattagctgggcatggtggcgagcacctgtagtcccaactacttgggaggctgaggcaggagaatcacttgaacctgggaggcggaggttgcactgagccgaaatcacgctgctgcactccagcctgggcgacagagtgagactctgtctcaaagaaataaaataaaataaagagaatattttaaacataagaacaccgtcaacacacccaaagaaaatgaacaggccaggcatggtggcttacatcccagaactttgggaggccaatgcaggaggatcacttgagctcaggaggtcaagtctgcagtgagcagtgatcatgccactgcacaccagcctgggtgacagtgacagtctgtctaaaaaacacatatatataaagttaaattactgtattttaaaatcacttaaaacaatactaccaattcaatagttaggcttgtttctttcattttgttttttatttttagtgactgatatttttattgaggtaaaatttacatacagtgaaatctatagctcttaattgtgtaattttttttttttttaagagacagggtcttgctctgtggccgaggctagagtgcaatggcttgatcatagctcaccacagccttgaactcctgggctcagctcctgggctcaagcaatcctcccagctcagtctcctcggggctgggactacaggtatgcaccaccacacctggctaatttttctttcttttgtagagatggggttacactatgttgctcaggtgggtcttgaactcctgggctcaagcaattctcccacctcgacctcccaaaatgctgggaacacaggcatgggccaccgtgcttggccagtaatttgatgagctttgacaaacatatacagccatgaaacctacatatcaatcaatatatagaacattgtcatcactccagagagttattcatggtcccttccagtcaatccccattccacaaggcagtcatattgtaacttctatgaccatagattaattttacctgtaatactattttatataaatggaatcacacagtacgtggtcttttgtgtccagcttcttttgctcaacattttgcatgttgctgcatgcatcagtacttcattctttttcattgctcagcaacattcaattgtatgcaacacaacttgttttattaattctcctattactgcatatttgggtttagactattataaataaagttgctatgaacatttataaacaattcgttttgtgaacatttgttttcatttatcttgggtagataactagaagtggaactgctgggtcataggatgtgtgctcctttcactttataagaaactgccaaaaacagtttttgaaaatgactgtaggccacctgcagtggctcgtgcctgtaatcccaacattttgggaggctgagttgagaggttcgcttgagccagaagttcaagaccagcctgggcaatacagggaggccttatctctacaaaaaaatgttttaaaaattagtcaagcatggtggcaccagcctgtagtaccagctactagggaggctgaggtgggaagatcaattgagcccaggagttcaaggttgcagtgagctatgatcgcaccacttgcactccagcctgggcaacacagcaagactatgtctcttaaaaacaaattaaaaataaataaataaaatgattgtataattttatacttccactaacaacatattagtttcaggtgctccacattctcactaacatttggtttgtcagtgtgaagtgatatctcatgtttgttttttttctcatttttttttgagtctcactctgtcacccaggctggagtgcagtagcgcgatcttggctcactgcaagctccgcctcccgggttcacaccattctcctgcctcagcctcctgagcagctgggactacaggcgcccgccaccacgacctattttttttttttttgtattttttagtagagacggggtttcactatgttagccaaaatggtctcaatctcctgtcctcatgatctgcccaccttggcctcctaaagtgttgggattacacgcgtgagccaccgtgccctgccatttgtttttttcttgaggcagagtctcactttgtcactccagctggagtgtgatggcatgatctcagctcactgcaacctctgtctcccgggttcaagcgattcttgtacaacctcccaagtagctgggattacaggcgcacaccaccacccccagctaatttttgtatttttagtagagacggggttttgccgtgttggccaggctggtcttcaactcctggactcaagcgatcaacccgccttggcctccaaaactgctgggattacatgcgtgagccaccttgcccggcctatcttgtgttttttagtcaactttatatatcatttatgtacaattaaaattgggcccattttaagtgtagagtttgatgagttcaataaatgggtgcgtgtgtgtgtgcgcgcatgcgcgggtgtgtgtagctatgactccaatcaaatatagaacatatcaatcacccaaaaagttccctgtgccctttgcaatcaattcccagccctgggcaatcatttagttgctttctgtcactgtagattagttttgcccattctagaatttcagataaacttattcatgcagtatgtactgtgacaaccatgaaaatgtaccactgggctgggcagagtggctcacacctgtaatcccaacacttcaggagcctgaggcaggtggattacctgatgtcaggatttcaagaccagcctggccaacgtggcaaaactctgtttctactaaaaatacaaaaaattagccgggcatggtggccagcgcctgtaattccagctactcgggaggctgaggcaggagaattgtttgaacccgggaggcggaggttgcagtaagcagagatgacgccactacactccagcctgggcaacagagcaagactccatctcaaaaaaaaaaagattcttcctttccaatcctccttccttccctctctccttccacagatgtcaggcttacatcttagtctgaagtctcaccctgccttctcctgattcttctttgcagtgttttaaaatatagtcagccttccctatatgtggattctgcatctgtggattcaaccaaccatgaattgaaaatattcagaaaaaaagggtggttggttccgtactgaacattcacagacttttttttcttgtaattatttgccaaacaatacacctatatacatagcatttacactgtattagttattacaggtaatcaagagacaatttaatgcatacgggagggccaggaatggtggctaaagcctgtaatcccatagctttgggagaccaagatgggaggattgcttgaggctaggagttcgagaccagcctgtgcaaaatagcaagacccccctcctcatctctacaaatcaatcaataaattaaaacaaaaattttttgagacagagtcttgctctgttgcccaagctggagcgcactggcacgatcacagctcactgcaacctcaagtgatacttttgcctcaagtgatcctcctgctttagcctcccaaagtgctgggattataaatgtgacccaccgtgcctggccataaatactattgaatgaatgaatgaattccaggcattgtgctaagcatatttaaaaggttgttccacttaattctcaaaataatccctataaggtggggtgctattattttaattttacagacaaggaaactgaagcacagagaagataagcaagttgccaaagttcacatagttggtaagtaagaaagtcagttctgcagaagtagttgggtttgagttcggtcatatcccttaaatcctttgtggaatgagatgaatctttattccacaaataaggtaaaggtaaataaataaatccttagatgagttaaggaaaacagagtattcaaggaaaaatgaacagcctaaacaaaaaatacaagaatgagaaaaaggcaagtggttcagactgactgaataaaaaggttgatacaggatatttgcggccaggcacggtgtctcactcctgtaatcccagtactttgggaggccgaggcggagagatcacctgaggtcaggagttcaagaccagcctggccaaatggtgaaaccctgtctctaccaaaaatataaaaaattagccaggtgtgttggtgcacacctgcaatcccagctactcgggaaggtgaggcaagagaattgcttgaacctggcaggcggaggttgcagtgagccgagatcgtgccactgcactccagtctgggtgacagagcgagactccgtttcaaaaaataaataaataaaattttaaaaataaaataaaaacaggatatttgcaggaggtaatgttggaaagggaagttagggcatattatgaaggatctttgagaaggaactgatgagaagaaagacaaagtatttgtgattttgtgatattgtaaagggaataatatttcttcaacccaagcattccttgaaaggaaataactccattctatgaatactttggggaaaaaaaagatgcaaaatataattcacacacaggtatggcctgaaaactaagttatatagttaggtttgaatcctctttaccaccatcatctctaccaccacaaagaaaatccttaagagatccctgcagtaagaggtagctttgctcagattaaaagaaaagatggtatcagaggtcacagccaaacactaccttccatttcacaggctaatgaaatggataagggaagatggtattgataaattatttttttcgcttttgggaatcactttcttaaataaaagaatgtgggaagtgagggaagaaaaaggggaaatttcttcattgtcctttgcaatgctctgcagggggaaggtaaacccagtcccattgctctgcccatttacttaatgtgaacaaataataattagaaaaatatttattgtgggcctcctctgtggcccagacatagtaataaatgcagacttcttccccatctcaacctttttagatattattttactcagtgcctttttaaaggttattttactccatgcctttgcagacaaaccagctgttcaggctgaggtgaccctatggctgctggtatgcattatgatcatagtatttcccccaaaagccaaggataagcctctgacacagcacttctgtaatccaacacgcctctctctgggtaagaatgctttacaggcagaactgagtgcagggaaggaatctgagctgtatgcagctcccttggatattttggtggataaaaccatgcaatccagcagagcagggctggagttctgccaaatgagctcagacccccagaaaaactaatgacattcatcaggctagaagagaaggcccagcatcttttctttatgaattgccagagctgccttaaatcttatggagactttaagcattgaaagaattatgatgttcttctctcctatgaacacctaattcaagatgagtgcaactaattgcaagtaaagctctgatttttcatggggacaactttaatactttaaatgccaaatatgaaattatttccagaaaaacttagagatgcccttcccactttgttaagagtgtgcttaatttacctattggataatttatcactatacattatgaaggcctgggggttgagaattccctaactggtttaaacttagccgatacttttcaaaccatttgagatttatactatcttttgccttgtgctgactccagtgcataaccaaggaaacagcctataatagtgccttcctcttgcacctcttctaacctcctctttcagtggtggatccttagacaccttcgacaattcaagggtccttcatcacagttcaaaagcattggtgtgccactatatctgccaattttgcttgacaagactgtggaagaagctacagaattggagagctcccaaaagatcatacttggtcattccagggggtcaatagttaaatgaaacaaaacaggaggctccatagccatcaaacactactacctgtgtctgacaatcatgcatatcacaggtccctaataatccccttgaggcaggagaatagtgtctggagacagggagccttcacttcagcctctgattggtgggagccaagtcttcatttgcaaagggtgtaacttcacttcagcctctaattggtcacaggccaagccaccacttcagcctccaataggtcgcaggccaagtcttcatttacataggatgtaattaataggaaacctctaaagggtacttaaacccaagaagatttgtgcaactggggcccttgagccacttactcgagcccactcccactctgtggaatgtactttcacttcaataaatctatgctttcatcttccattggtttgtttgtgcattttgtccaattctcttttttttttttgagatggagtctcactctgtcacccagcctggagtacagtggcacaatctccactcactgcaacctccacttcctgggttcaagcaattctcctgcctcagcctcccgagtagctgggattacaggcacccaccaacacgcccagctaatttttgcatttttagtagagatggggtttcaccatgttggccaggctggtctcgaactcctgacctcaggtgatccacccacctcagcctcccaaagtgttgggattacaggcgtgagccactgcgcccagctagtccaattctttgttcaatatgccaagaacctggacaactcgtagtcaagaccctccactggtaacacccttggaagggcctttgaattgcatcgttttactaccaggcttctgccatagcacacttcctaaattcaatatagatttttaaatactttataattcatatatgtatttaattttttatttagctttctaagtcttatacatatgtatcagagcattttctgtctttgcttataaaattctgggacacagatgctaatgctccacagttttcttttttcttttttttttttctgtttgagataagaggcttgctctgttgcccaagctagagcgcagtggcgagatctcggctcactgcctcctgggctcaattgatcctcccatctcagcctcctgagtagctgggactacaggcacacaccaccacacccggctaatttttgtattttttgtaaagatggggttccattatgtaccccaggctggtcttgaacttctgggctcaagcaatccacccgcctcagtctcccaaacagctgggattacagatgtgagccaccactcctgtccagttttctttatagagcactttggacaagtgctatgtgcaatttaacacttaaacatattttctgggccgggcacggtggcccatgcctgtaatttcagcactttgggaggccgaggtaggtggatcatgaggtcaggagtttgagaccagtatggccaacatggtgaaaccccgtctctactaaaactacaaaaattagctgggcatggtggcgcacgcctgtagtcccagctactcaggaggctaaggcagaagaatcgcttgaacccgggaggcagaggttgcagtgaaccaagatcacgccactgcactccaacctgggcaagagagcaagactccgtctcaaaaaaaaaatttctgggctgggaacagtggctcacgcttgtaatcccagtcctttgggaggccaaggcaagaggactgcttgaggccaggagtttgggaccaacctgtgcaacacacaaagaccctgtctctgtgagaccctgtctcaaataatcctagctactccagaggctgaggtgcaaggatcacttgagcccagagtttgaggttacagtgagctacaatcatgccactatataccagccttgctgacacagcaagactctgtctctaaatatatatacgtatattttgacaatataatcatactggaatcatcacccagtggaatggctggaatactgttaaccaaggaaagaggaggataattaacagacacctatagccaatctttctgtgacattgtcagactttggcagtgagcctgcaaaatactcatccagcacacataagcaattttagtactatcataatctacatttgcactgtaattaataaaacccaattttagcagggcctgagatcacaaggctgagtttctgcccctaccatctaatcagtgtgtgatccttccctataccattcagatctattgtctagtctctttgtgagacttgatgaaagcagaatctttggttaactactgctgacctttatactgagaccctgtgctagttagcggcctcatctctgcagttgctatggaaactgtccctttctccccacaacctattctggctctctgcctccacatggtactcttactgattgcagaagaggaggcctgtaaatctctccaagctcttttccagattcagatccacaaacggggggggggggggcagaggtacagcggaacaccgtctcatgtgtcatagtcatgagactagagggtgaggcatccccagcatctgacattctgccagtactcttattttcccctttctgtgcaaaaaggattttcagggccatgtccaaattggttgcagagtggactggctgttttcctgtaacacatgctccatggtagggaccaggattgctgtaaagttttttgttttgttttgaaacagagtctcactctgtcactcaggctggagtgcagtggtgcaatcctggcttactgcaaccttcgcctcccgggttcaagtggttctcctgcctcagcctcccgagtagctgggattataggcgcccaacaccacgcccagctaatttttgtatttttaatagaggcagggtttctccatgttggccaggctggtcttgaactcctgacctcaagtgaaccacccactttggcctcccaaactgctgggattacaggcgtgggccactgtgcccggccgctgtgaagtatttaacatgcagacactgcccaatcagaacgtggctcacaggcagccttgctgaatctgatactgtgttcctttctttcctgtactatctccaaagcaaaggcaaacgggacaaaaaaaaacccaaaaacccaaaaaacaaaacaaaacaaaaaaacaaaaaaacaagtgctgctggagccctagggtgaaagataggcgctcccatacatacatgtacagaatgattcggtatcctgggtaaaagactactctggagtgtggagtaggtggagacacactgaggaatgggggaggctagactaacagcacttttttacaaagatgttccagtcagtcataaaacagtgcaaggcctcctcagtcctttcccaacctctggttttgatcttagaactgtcaaccccttctttggtgcaaacactgctccttctgttttaagaactcccggggggtgggagggggggaagtaatacaacagtctcctgagggagacccatctcactgtcacatcacttgaagatgggaaggtctttcctaggttttactcaaatcccccttgctgcagtctgagctcattgcactcgagtcctgcactcagcagagatggaaactagccagccaactgctatcttcagaataacaactcaccagggactcaaggccggaaggtcattctgtcccctccaatactgcgcagccttccagagcactcccagggcccggggcaaggacagggaaaccgaggatggagacctcgggcaggacccaggcaggcagtgacaaaaaac

SEQ ID NO: 197 - DNA, 124318 bp, Homo Sapiens
cgcactcctgggcccgcccagccgccatcttggtctaggagggagcgcgccgcacgcgtgagtaaacagccggagctgggaaagtcgagctctggcagcgtctgggtgctgaggggcagaggcggagagaaccctgtcctgatcttcctaggtgggataaatatcggggtgacagtggtaggccgcggggaaccctcagtctgcccaccctccgccccctcgcggcgagatgcctcgttccccgggcttctcccgccctccgccgatctcctccctctgttgaaagctgcccgggaaagtggtggcgggagcgggcccaggcccgaatgtggcgtgggctcaggtgtctggtgtcgggcgccggaggaggttcgcgctggggtttggtgattcggaggcctggggtgcagacgcggcgtggctgtgaggcccgggcgggcgtgcgggtgtgagggccggactcacactgggccgccgcggggctgtttccatcggtcactggattttctcctcttccggttcgggcctcagggtggccgacatgacggccaggggtcagagccccctcgcgccgctgttggagactttggaagacccttctgcctcccatggagggcagactgacgcttacctgactctgaccaggtgaggtccgccacggggcgtagcggagagtggggcgctctatagtggggagaaagaaggtggttgggaggggcgcgtagaatgaatgtgagttctagaagtctagcaaatgtgaggacgcccgagtcgcggacgccttggggggcgggggagatgtattctaggtgacgttcccgggtactgctgctgctgcgcttgaggtgtgtgtttggaacgagggagcatgcacgtgtgttttgcaagcgagggatttttaaaagtttcggttggaagtagttgttggaggaggggtcttcagtgtaaacctccgatgtgttgggaaaatgtggctacccagagtttttttaacagagcaatacactgatttttattaattgcaaaatgcttcaaagtaattttcatagaaatgtactaaagttttgtaaaaccctttggaaaggcttagcaaatcgttagtaactaggaatagggatccctgttctgtctttttggagtcaggttgtcacaacttgcatgtactcgatgtaaaaacttattctgagggtttttctactttcatttctgatatatattgcattatatattctgtatacccttaaggaccttacctactgggtcaattcatttgcaggagttagaaagtaatttttaaaaagattgtacatgtatttttgagagtatttttttttttcctgtcaactacttaaacttgtgttcttcctgctttttaagtcgtatgactggagaagaaggaaaagaagtaattacagaaattgagaaaaaacttcctcggctgtacaaagttttaaaggtatgtatctgtttgttaaacagtttttcacttttggtagtttggtttttttttttggttttgtttttttgttttgaggtgtagttttgctcttgttgcccaggcgagagtgcaatggctcaggctcgggctcggctcactgaaacctccgcctctcgggttcaagcgattctcttgcctcagcctcctgaatagctgggattataggcatccgccaccgccccggctaattttgtatttttagtagagaaggggtttctccatgttggtcaggctggtctcgaactcccgacctcaggtgatccgcctgcctcagcctcccaaagtgttgggattacaggagtgagccactgtgtccagccacttttggtggtttttaaaagttttgccagttgactcaaaagctttgaatctaaaataacagcaataatactgattataatactctttattgttacttaaagcttctcaggtactttcttaattaccttacacgctttatcacttaactctccatggttccatgagattatttcttaatgatcactttgcaggtgaagaaattaatttaatttgcctaaagttgcctaggggcacttgaatctgagtttgtgctcttgaaagcagagatcagagattaatctgttttctttccttttgggaatctacatctaagtaagtgcttctaaaattacaattgtctttggtctaatctaggtagcattaatttctttttcctcattcaccctcagtttttgctacaaccgttatcatttttgctttagggaaatgatgtttgacatcatactgtggacctgtgttcctgtcttcacttgcctacttaatggcttcctgactatccttaacatcttttaaatttccttgtttttagaatgaaaaagttgaacttttatctccaaagtttgagttctcatttttatgaccttgttctctttttttaattttttttgtttgtttttattatgaccttgttcttgtgcttttatttttgtttttaatttttaaaattgaggtgggggtcttgataggttgcctaagccagtcttgaactcctgggtccaagcgatcctcccacctcagcctccttagtagctgagattacaagtaggtgccaccatgcccagcttttgtgctttttgtttgtttgagacagagtcttgctgtgtcgcccgtgctggagtgcagtggcacaatctcagctcactgcaacctctgcctcccaggttcaagtgattctcccgcctcagcctcctgagtagctgggattacaggcatgcccccaccacacccagctaatatttttagtagagacgggctttcaccatgttgaccaggctgatcttgaactcttgacctcaggtgatccacccgccttggcctctcagagggctaggattataggtgtgagccaccgtgcccagccgtgtgcctttaaacaagtgtttcatccagacatgtacattttaacgtgatttttggcgaagtattaacagagatactgcctactcttggtggtgtcacagtcatcaacattttttgtgtaagcagaaactttattgtgtgctagttacttaatatcagtgtttattccattttcttcattatcatattccatattataataattagatgtgaagacatgcactttcgtgtattgagtatttataggatcaggaattctattgcatactttttttttttttgagacggagttttgctcttgttgcccaggctggagtgcaatggcttgaacacctcctgggttcaagccgttctcctgcctcagcctctcaagtagctggggttacaggcatgtgccactacgcccagctacttttttttttgtatttttagtagagacgggggtttctccatgttgatcaggctggtctcgaactgccgacctcaggtgatccgcccaccttggcctcccaaagtaagcctgggccattgtgcccagccttactgcatacattttgagtcaagttgcattgttcgtaaataggatttgtacctgaaattatttggatgcacatggaaggttgataataggacaataagcaattttaagcaatgaaaggataattgaattctttcagagtaggaaccataccaggtaaaatagaacatgtttatatgtcgtgttcagagttcagctaggattgtgtctaggaatctacaacattcttgaaaatgagacacatcatcgttaaggaacactttcaagtaagtttaatgaagattaatcacaaacatttactagctgttatccaggagatacactagtagctctcaaagtattaagccttacttagttgcttacaactggttgctgtgctatatcccttacattctgtactctaggatttgcattttttggcttcgttttgtaaatatagaagacactgcagggaagtatctgctcatatatttaaccatttacatttgctattcttcctgctcaagaataacaattgaagattccttggatatttgattcaaatagatatgggggttttgaagataaatccctttggagtaggaaatggtacaagggaaatggggtacagggtaaaagtaaactttcatattgagatactctttgacagatttggccttttatagcttttacataaatggtatgagttgggctttaaattctagattgacagccaggcacggtggctcacgcctgtaatcccagcactttgggaggcctgaggcgggtggatcacctgaggtcaggagtttgagaccagcctggccaacatggtgaaaccccatctctacaaaaaatacaaaaatataggcatggtggcgcgcgcctgtcatcccagctgctcttgaacctgggaagcagaggttgcagggaactgagattacaccattgcactccagcctgggcaacaagagcgaaactctgtctcaaaaaaaaaaaaaatttctagattgacatggattgaaattctcttatgtataaggtttaaaaaattgttttattttactattaattgagataataatagatactttataaacgttacattctaaccccttccttctcccagtcttagaggaagagatgtcactccactctaaagctaggatgttagcttttggatttgagtctcttgtttactcagtggaagggccttgctcccttttccctgtcatgtctttagcatctttcatctgttgacctctttgctttcataggtgtagagatatcctttatcttcattcaggtgatctcgatccagtttcctctcctttctttaccaagctgtacacatggcctttggattttattccttgtttatttttatttttattttttatgcgtattctcaaggatttgttggagtaacatgatgaatatgcttgttctgtaatcaacttctgctttctaaaaattgatttacagttgtgcttgtttgtaataaatgtgattttgtttttgtagactcacatttccagtcaaaactcggagctgagtagtgctgctctacaagccctggggttttgcttatataatcccaaaattacctcagaattatcaggtagataaatttcttatgacttaatatttttagagtataaagtataagttttaagtataagtagtttgatgctgttaaaagtactgttatgtctggattagtttcagaacctgtagtttaaggtttgcttttaagaaagaaagaatggctgggtgtggtggctcacgcctgtaatcctagcactttgggaggccgaggcgggtggatcatgaggtcaggagatcgagaccatcctggctaacatggtgaaaccccgtctgtactaaaaatacaaaaaattagccgggcaccgtggcgggcgcctgtagttccagctactcgggaggctgaggcaggagaatgacgtgaacccgggaggcggagtttgcagtgagtcgagatcgtgccattgtactctaacctgggtgataagtgagaccccatctcaaaaaaaaaaaagaatgtttagattatcattacctacacatagctctaacttcgatactacaaaatttgctcttaaaaataatggtatttgacaaaagattagccgggcgtggtggcaggtgcctgtagtcccatctgctggggaggctgaggcaggagaatggcgtgaacctggcaggcagagcttgccactgcactccagactgggactctgtctcaaaaaaaaaaaaaaaaaaaaaaggatattgctgggtgcagtgtctcatgcctgtaatcccagcactttgggaggccgaggcgggtggatcacctaaggtcgggagttcgagaccagcctggccaacctggagaaaccccgtctctactaaaaatacaaaaaaaattagctgggtgtggtggcgcattcctgtaatcccagctactcgggaggctgaggcaggagaatcgcttgaacctgggagatggaggttgcagtgagccaaggtgttgccattgcactccagcctgggcaagagtgaaactccgtctcaaaaaaaatcaaatgaaaagggtatttaaacatgattgctgtaaaaagggaaacttttattcaggcatatgcactaaggaatatgctgaattgaaaagttctttgacatgataaatgtgggataatttggaactaaaagtggtaatgaaagcacagaacctaatgctttccaagttttcaagtagtctgcactgttgctccatagttagatgatttccattgtaaaggaaacccttatctttagagaagggaagttaggaataaagatgtcaaagttgttaccatctgtttttgagggaaaagctgctgcctgctcttttttatacatggaagtgttagcaacctaaagcaggagttgttcattttggagcagagatgcaggattgaaaacatcttaccaaaaattgtcttgtatgttcaaacctacagtgatatctagttatttcagttgcacaagatatctgatttggtgtctgttgttttattttctctcagtatatcctcccctctaatctgaattttgtgtttttgggagaagtttggtatcagcattggttctctgatctgttctctggatatacatttaattttatgattgatgagtatattgttttctctagttttatatttgagactttaaagagtatcacctattctatacaaaattaaaactgcttgtttttcagaggcaaatgctctagaattgctttcaaaattgaatgataccattaagaattcagacaaaaatgtacgtactagagcactttgggtgatatctaagcagacatttccctctgaagtggttggcaaaatggtgagtatagtttttgggtatgccatcttaactatatgccaattaaaagaaaaaactataatgccaataaaaacagttcaggcttatttcatttgtatttatttggttcgttttttaggtatccagtataattgattcattagaaatactgtttaacaaaggagagacgcattctgctgttgttgattttgaagcattaaatgttatcgtaaggtatgcatttggatgttgtgcaaattgaagaatagttttcataaatttagctgaaggagagggtttttgggatttaaatgagagacagacattaaaaggggggaatgtcatttacaccaaacgactcaaggacaaaaagtaatagaaaaaagatggaagtagatatgtgtgggttactaggttttttgtttatttttactgggaccatgttcaaggtgaagtcttggttatgttcctgctagtaacatacacagttcaggtttgaaaaatatcttaaagtttgtgtaaggatttaaaaaataatgtaaactcataagtgggcttgggttgtttaggaaggcagtcagtgtttagcagggaatagagtaccttcttcatttttgttgtaacaggcatgccaacgcataaactcttttaagtgtaaactctttgatgacatttctgtcttccctgttttttgttctttaaaattttcttgttgagttacttgctttaacttccccactgttgaatgctctgattgatgctaagattatgtcatggttctctggctatccttttctataacaatgatgaatttagtaatataacaataagtaatacagttggccctttgtaggttctgcatccttggattcaaccaattgagggttgaaagtctcagaaaaattgcatctgtattgaacatgtacagactctgattttcttgtcattatttcctaaacagtacagtataacaactacttacttagcacttacattgtattagctattatcagtaacctagaaatgatttaaagtatatgggaggatgtgcgtaggttatatgcaaatacagtcatgtgtcacataatgatgggaatacattctgaggaatgcatcatgtaatttcatcattgtgcaaacattattaagaggacttacacaaacctaggtggaatagcctactatatacccaggctgcatggtacaacctgttgctcctaggctacagacctgtacagtatattactgtactggatattgtaggcacttctaacacgatactatttgtgtacctaaacatagaaaaggtacactaaaaatatgataaaaaagattaaaaaatggtacacctgtatctcacacttaccacgaatggaggttttaggactgaaggttctttgggtgagtcagtgaaggagtgatgagggaatgtgaaggtctaggacattactgtgcactattgcagatttcataaagactgtacacttaggctatactaaatctataaaaacatttttaaaataaattaacctctactttctgtaactttatttttttgagacagtctcactctgttgttcaggctggagtgtagtggtgtgatatcagctctctgcaatctctacctcccaggttcaagtaattcttgtgcctcagcttcccgagtagctgggattataggcgtcagccaccacacctggcaaatttttgtatttttagcagagacagggttttgccacgttggccagtctggagttgaactcctgacctcaggtggtgcacccacctcagcctcccaatgtaccaggatcacaggcctgaaccactgtgcctgggcagcttactgtaactttaaaatttttaaactttttgacttttgtaagaataattagctttggccaggcacagtggttcaggcctgtaagaataattagctttggctcacacctgtaatcccagaactttgggaggcccaggtgggtggattacctgaggtcaggagtttgagagcagcctggccaacatggtgaaaccccatctctactgaaaatacaaaatcagccgggcgtggtgacgcgtgcctgtaatctcagctatatgggagactgaggcattgagaatcacttgcacccgggaggcagaggttgcagtgagctgagattgcaccactgcactccagcttgggtgacagagtgagacttggtctcaaaaaaaaaaagaatacttagcttaaaacacaaacatacaattgtgcaaacatattttccctcgttagatccttattctaggagccttaaattctttttttttttttttttttttttaactttcataactttttggttagcaacataacacatcagcctagggcctctgcagggtcaggatcattctactgtctcccacctccacatcttgtcatactgaaatgtgttcaggggcagtaacatgcatggagctgtcatcttctgtgattgatgctaccttctggagtatctgctgaaggaccctcaaggctactttgcagttaactttttttaaatacaagtaggagtaaactctaatgataaaaattatagtgtaggagtaaactctaatgataaaaattatagtgtagtatatacataaaccagtaacttagtcatttattttttgtttttttattactattttttttgagacggaatcttgctctgtcaccaggctggagcgcagtggtgaggtcttggctcactgcaacctccgcctcccgggttcaagcaattctcctgcctcagcctcccaagtagctaggattacaagcatgtgccaccacacccagctaattgttgtatttttagaagagacagggtttcaccatgttggtcaggatggtctcgatctcctgacctcatgatccacccgcctcggcctcccaaagtgctgagattacaggtgtgagccactgcacccggccggtcatttattatcattatcatatagtacagtattatgttctatatgtaaatgcgccgtacttttatatgaatgagagcgcagtagatttgtttacaccagtgtcatcagaaacatgaataatgtattgcactgcagtgttacaacagctatgatgtcactaggtgataggaacttgtcaggtccctcataatcttatgggaccaccattgtgaatgtgctgcatctttgaccaaaacgttgctctgtggtgaatgacaatactgtccttttcatattggacttgagcattattgtgaggtcctggaaccaatcccccagggatactgagggatgactgaaatgtttcaatctaaagacaagattggttctttaaaaaaaatttacaaaagcaataatgtgcaaattcgtaaaaataagatctatttcttgtgtgtatatgcatatttgtatatattctaaaacaaatgggccgtactgtgtatatttctgtttcacctattttactgcttgtttagacttaaaacatgaggtcacgctaattattcattgatttctctattataggctaattgaacaagccccaattcaaatgggagaagaggcagtgaggtgggcaaaactggtcatacctttagtggttcattcagcacaaaaggtacatttgcggggagcaactgctctggagatgggaatgccattattgcttcagaaacagcaagaaatagcatctattacggagcagcttatgactactgtgagtgttcttttatgtaagaattttctggatactgcatcggaaggttctgcactaagcttaaaattcagtctggtggccaggtacggtggctctcacctgtagtcccaaagcgggaggctgaggtgggaggattgcttgaggccaggagttccagacccatctgggcaacatagtgaagacccatctctacaaaatatcttaaaaattagctgggcgtggtggcatgcgcctgtagtctcagatgcttgggagactaaggcgggagggttgcttgaccagaaatttgaggctgcagtgagctatgatctcaccactgcattctagcctgggtgacagaatgagaccctgtctcaaaaaaaaaaaaaaaaaaaaatctgtctgggcatattggtatagttgcactatgatataggattttagctttgaatcaaaaccttaagagttgcataagttagcaaaggcacattgctcattacatagtagtaaggaagggagctatctattgttgctaaaatccagacattttacttcattcccaataaataggaaataggaattgtatttctgaaagagggagagcattaactgattgactcatgtttgggttgttactgtataatcccagtagatacaaatttaatgtacataaacttacctagtctctatagttttctagttattacttgccacaggttttaggttttctaaccattgttgttctaacatatttactgggcatctgatatgtgcagtgcattgttgcaggcgctgtgaatatagcagtgaacaaaagaggcttgatggagcttattttcttgtgggagagataattaagtacatagtgtagtaagtgaagaccactaaggagaagagcaaggaccggagagtgctgtgagaaaggaatgtaaggtggtcagagaaggcaaaggaaaggacatttgaacagtgatttgaaggcagagtaggagttacccatgtagataaagaaccagacaagagaactatgagggcaaaaggccctgctctaatggttgtgtacctggttggtgttctgggaactctgggcagtatgacagtagtggagtgaatgagagtgagaggaaaagagggcccaatcacataggactatggcagggaccattgtaaggatggatttttactctagattacatggaaagccatatttgaaggtcttgttttgttttttgtttgagacaaggtctcactatattacccaagctggtctcgaactcctgggctcaagcaatcctcccacttcactctcccaaagtgttgggatgacaggcgtgagccaccacacccagcccctaaaacctgggattttacttgcttaaaatgcagaagacttcgtggtaatgttcagtatgacacagtaactcgagtgtctcataaatagctttattctgatgaattcaattttagtgacatatataatttttttttttttttcgagacagtttcgcaattgttgcccaggctggagtgcagtggcgcagtctcagctcactgcagcttccacctcctgggttcaagcgattctcctgcctcagcaggagtagctgggattacaggcacctgcaaccatgcccgaccgatatttgtatttttagtagagatggggtttcaccatattggccaggctggtctcgaactcctgaccttgtgatccgcccgcctcggcctcccaaagtgctgagattgcaggcatgagccactgcgcctgaccataaaattctttctttaacccatttatcaagcttgcaacaaagcatatatgaaattctttatataaatttgagctaaaaattatttcacgtgtctgttgattatgaagctattaatgtattttttcattattgtgaaaaaatacagtgtcatttaaactagttaatgatatgcatgctgacatttttagggtaaagtatattggtagaaaaaaaaagttggattgatggatggtaggatggccagataggtgataagaccaacatagtaaagtgttaatggtagaatctgagtgtttgtattagagcatttactgtaaaaactcactcggatttgctatatgcttcagttttccttttggagtcttttgggaaaatttttttttttttttgagacagtcttgctctgtcgcccaggctggaggacagtggcacgatttctgctctctgcaacctccacctcccaggttcaagcaattctcatgcctcagcctcccgagtagcaggaattatgggcgtctgccaccatgcccagctaatttttgtgtttttagtagagacagggtttcaccatattggccaggccagtcttgaactcctgacttcaagagtgaggccgaggcaggtgattctcctgcctcagcctcccaaagtgctgggattacaggcttgacccaccgcacctggccttgggtggggtaatatttttattatggagaaaactatttggttgaatcagtttttgaaaattattcctagactttggtattggatttttttttctaagagtctgtttggtaaattaattgcttttgtttgcagaaattaatctcagaacttcagaagctatttatgagtaaaaatgagacttacgtgttaaaattatggcctttgtttgtcaaactacttggaagggtaagtgcccagttaatgaacagtcaacagtttttacatgctggactctttattttcttaccttttctttgtacagttgatgctcattatttcctttgtacagctgatgctcattatttcatgcctactcactaaaatttatttgtaaatctgaaaccagtacttgcattgcttttgctttcatttgtagacacccaaagtggcaaagaattggagtcacacaacgtgcatgtttccagctgaggtcaagcaaggttacgctctgcctttttgttttagttctcataccttaaacaggtgtcctttttataatccatgtaatgccacatttttcacttttctgtgcttttcctggtggtttcactgtttaaatttggaacctaaagcttgggtccaggtgctttctagtttgtgttcctaagcaaaggaaggctgtgatatacccaatggtgaaaataaactttgttcaggcatgatttatagagctactggctgtgagtttgatgttagtgattcatttgtataaaatatcttctaatagacgttaagcaggttatatattgaacagctgacaaaagtgttgtgtccagagaacctaaccctgtatttcccatgggagtgatcactcagtatttgccaatttagtgttcaaggctactttatataatagaaaaccataactactatgaataatgagagagaatcaactgtatgttcaatgattaagccaggttttgggtggtagggggtgtgctgcttttattgtggtaaatatacatgttctaaccatttgtaaatgaacaagtcagtggcattaaatctattcataatgttgtaagcatcaccactatctatacccaaaacctgtgcatcatccctaacaaaaactgtacccattaaagagtaaacttcctctgccctcctcctgcacccagacatcaccctttggtaatgtctgttctacttcctgtctctgaatttgcttattctaggtacctcataaaagtgaaattataacatatatgcccttccgtgtctggcttatttcactaagcataaagtttttttatttttctctgagacggagtttcgctcttgtcacccaggctggagtacaatggcgtgatcttggttcactgcaacctctgcctcccgggttcatgcaattctcctgcctcagcctcctgagtagctgggactacaggcatgtgccagtatgtccggctaatttttgtgtttttagtagagataggatttcaccatgttgaccaggatggtctcgatctcctgaccttgttatctgcccacctcggcctcccaaagtggtgggattataggcgtgagccaccgtgcctggaagcataaagtttttaagatttatccatgtcataacatatattaaagttggattcttatggctgagtaattgtatgtatataacacattttgtttatctgttgagagacatttaggttgtttctaccttttggctattgtgaataatgttgctgtaaacaccagtgtacaaatctgttggagttcctgctttcagttttttgggtatatgcttaagagtggaattgctgggttatgtagtagttctatgcttaactttttgagaaagctccaaactctttttttgagacaaggtctggctctatctatcacccaggctggagtgcagtggcacaacctcgctcactgcaacctctgtctcccagtctcaaaccatccttccatctcagcctcccaattacctgggactaccacccagcccggctgatttttttttttttttttttttttttttttttccatattttttgtagagactgggttttgccgtgctgctcaggctggtctctaactcaagtgatccgcctgcctcagcctccaaaattgttggattacaggcatgagccacttgaaccagccagcaccaaactcttctgtagcagctgccccattttacattcccaccagtaatgcactggggttccgcttccataatatcctcaccaacactttttattttcctttttttgatagccatcctagtgaatgtgaagtgggattgatttggtatagatttgcatttctctgattactagtgatgttgaacatcttttcacttggttcttggctgtttgtttcattgtctgtggagaaatgtctaagtccttggcccatttttgagtaggtttgaatttttgttgttgagttgtagttctttatatgttttggatatgcatcccttagttttgtgatttgcaaatatttaattccgttctgtaggttctcttttgctttcttggtaatatccattgcagagtttttaattttggtgaagtataatatatatattttttgttattgctagtacttgacatcatattcatgaagttgttgccaaatccagtgtcatttttgtttcccaatgctttcgtctaagaattttccagttttagatcttgaatgtagatctttgaaccattttgagtgaatatttggatatggtgtaaggtgagagtccacgttcatccttttgcatgcagatgttcagattcctcaatatcttttactgaagaggttgtttttattaaatccttgtggtacccttttttttttttttttttttttgtgagacagagtcttactctgttgcctaggctggagtgcagtggcatgatctcggctcactgcaacctctgtctcctgggttcaagcaattctcctgcctcagtctcccaagtagctgggattacaggcgcgcactaccatgctcggcacattttttttttcttttctgtatttttattagagaaggggttttaccacgttggccaggctggtctcgaacttctgagctctagagatccacccgcctcgacctcccaaagtgctgggattgcaggcgtgagccaccgcgcctggcctgtggtacccttttgaaaatcaattgaacataggtgtaaagatttatatccaagctcagtattctattcttgtggtctgtatggctgtccttatgccattatcatatgtattaattactatagctttatgctaagtttggcagtcagtttgtctggttttattatttttcaggattgttttggcttttaattttttttttttttttttttttttgagctggagactgtccgtgtcgcccaggctggagtgcagtggcgtgatctcagctcactgcaacctctgcctcctgggtccaagcgattctcctgcctcagcctcccgagtagctgagactgcaggcgcacgccaccacgcccagctaaatttttgtatttttagtagagacagtgtttcaccatattggccaggctggtctcgaactcctgaccttgtaatcctcccgccttggcctcccaaagtgctggcattacacgtgtgagccaccacgcctggctgttttggctttttgagactgcaattccgtgtgaatttgacgatcgacttctttatctgtgaaaaagacagttggaatcatggtagggattgtgatgaatctgcatataatgccttgagtagttagcatttcattgatgttaagtctttctacccatgaacacagatgtctttccatttatttagggttttttttttgttttttttttaagacagagtctcgctctgttgtcctggctatattggctcactgcaacctcagcctcccgggttcaagtgattctcctgcctcggcctcccgagtagctgggattataggtgcctgccaccatgcctagctgatttttgtatttttagtagagatggggttttaccatgttggccaggctggtctcaaactcatgacctaaagcaatccatctgcctcggcctcccaaagtgctgggattacaggtgttagccactgtgccaggcctaggtctttaatttctttcagcagtgcttcataattttcatcttgtgtctttaacttcttgggctagatctattacgaagtatttcctttagctcttatagctaacttgtgtgttttttattttctaaaccttttttttttgttaccggtttatagcctgttaagattatatgtggtttatagcctgttaggagcattcgtgttgatgtaattttttatttgtgatgcattacttgtcatttttccattttgtactttattttcctttttttcttttttttttgagacagagtttcactcttgttgcccaggctggagtgcaaacatgatctcggctcactgcagcctcggcctctcaggttcaagtgattctcctgtctcagcctcccgagtagctgggattacaggcatgtgccaccacgcctggctgatttttgtatttttagtagagaaggggtttctccatattggtcaggctggtctcgaactcctgaccttaggtgattcgcctgccttggcctcccagagtgctgggattgcaggtgtgagccaccgtgcctggcctatttttttttttaatttttttttttgtttttttttctcctgagctcatatttttctttttgtttgatagtattcccatttaaatcttacataatatttggaagtaattcagaagttatccggttttctaccagctgtggttgctcatgtctgtaatcccagcactttgggaggctgaggcgggtgggtcacttgaggtcagtagttagtcaccagcctggccagcatggccagcatggcaaaaccttgtctctactaaaaatacaaaaattaggccggcatggtggctcacgcctgtaatcccagcactttgggaggccgaggtggactgagttcaggagttcgagaccagcctggccaacatggtgaaaccctgcctcaaccaaaaataaaataagtagccaggcatggtggcacgcacctataatcccagctacttgggaggctgaggcaggagagtcgcttaaacctgggaggcagaggttgcagtgagctgagatccagccattgcactccagccgggtgacagagcaagactccatctcaaacaaaacaaaacaaaacaaaaattagctgggcgtggtagtattagccagtaatcccagctacttggaaggctgaggcaggagaatcacttgaacccaggagctggaggctgcagtgagccaaaatggcaccactgcactgtagcctgggcgacagagcgagattccctctcaaaaaaaagaaaagttattcagttttcttgatttttatctcacttttactattttttattagcagataatactgtttttaaaaaatatttcttttacagccatgaaataagatgtttccttaattttccattcagtttgtttgaaaggttatttttattattttcagggttcaatgccttttttctctaatataattttttaatgtatattttgtttggtattgatttgataaagtttgggatttatctgctctcctaattttctgttttagaaatgttctgtgttgtacattgtctgcttcttcaaactttatatattttgtgatcttgagtttagaatgtgtgtttaaagtttattttcttatattcctaagacttttaacatatctaacatttaacacatctctttatgttttgtgaataatttgtcttttgtctccccattagattatgaagtcctaagagcatctgttaagtgaatgaataaaggaatgatagcaattattctgtttcatgcagataaataacttcttaatgattttttcccctttttagaccttgcatcgaagtgggagtttcatcaattctctcttgcaactagaagaacttggatttcgtagtggagcacccatgattaaaaagatagcttttattgcttggaagagtttaatagataattttgctttaaatccaggtaagtaatattttaacaattttgattttctgtgaatttgttttgcttaaagcaagataaatgaagtttttctggttttttggattttaagttgaagttaagtaactactgaattattttcattttaagggaacaggaataaatttgtactgaaaatagaattcacatactaggcattggaaatcacaaatatgaaatctgtttcacagtatttcaaaaactgaacaaagtgaaaaataatgatttgtggcttccttttttatttatttatttattttttgagacagggtcgctcttgcccaggctggagtgcagtgatgggatcttggttcactgcgacccccgcctcccaggttcaagagattctcctgcctcagcctcccgagtagctgggattacaggtgcccaccactacacccggctaatttgtgcatttttagtagagacagggtttcactatgttggccaggctggtctggaactcctgacctcaagtgatccgccctccttggcctcccaaatgctgggattacaggcgtgagccactgcccccagcctattatttgtggctttcttacatgttagcactgagttgagtactttatgtatattttatttaatcatcacaatagacctgagatgtaattattaatcactattttagagagattgagtaattatccagaggtcacataaccagtagatgataggaagcagttgtgatttccatggaataaaaatatcagtgatcgatgaccttacttctttcaggatctctagaagagtacctaatagtggtttaatattgatatatggaagtcattctttttgatttactttaaccttatcttcttattgttcaatggagttttctgataatatattcacaagaaagaatatttagcccaaaactgtgttagtatgagtacttaactaggtggtagttaatcttagatttaattaacactgtatgtttacaagagctgctaagtaatgttgatttttatcctatatttttcctgccaaagaccattatttatcccatttcttcctccttttaatatgttttgtattgtgattatttgcattaatgtataataacttttttttttttttgagacggagtttcgctctgtcgtccaggctggagtgcagtggcacaatctcggctcactgcaagctccgcctcctgggttcacaccattcttctgcctcagcctcccgattagttgggattacaggtgctcgtcaccacgcccagctaatttttttgtatttttagtagagacggggtttcaccgtgttagccaggatggtcttgatcccctgacctggtgatctgcccgcctcagcctcccaaagtgctgggattccaggtgtgaggtactgcgcccggccttttttttcttttttgtttgagatggagtctcactgtgttgctcgggctggagtgcagtggcgtgatctcagctcactgcaacctccgcctcccaagttcaagcgattctcctgcctcagcctcccaagtagctgggatgacaggcgcccgctgccacgtctggctaatttttgtattttcagtagagacaaggtttcaccatactggccaggctggtctcgaacttctgaccttgtgatctgcctgcctcggtctcccaaagtgctgggattacaggcaagagccactgctcccagccctataattacttttatttaaaatactggtacattttgggggcatagtttccccccctccccccacttagggtcttgccctgtcacctagactggagtgcagtggctgactgcagccttgacctcctgggctccagtgatcctcccacctcagcccccccaagtagctgggactacaggcgtgtgccaccatttctggctaatttttgtattttttgtagaggcgggatttgaccacgttgcccgggctagtctcgagctcctggactcaagtgatccacctgcctcagccttccaaagtgttaggattacaggtgtgagccactgtgctcattctactacaatttttaattgaaattgtagcttatttttatgtttatgagctggcatgtatttgggtctaactgtaaacccagaagtgtgaggtaatgtttgggactacaatctttaggaattaagttaaagcataaaataagagtagtttaaagatagtaagttaaaaataagttcagagctagggaatccatgactgatgctgtggatccgggaagtcatcaaggaatcagatgactgtatttttactctgccatctttgatttgtcttaattgcagacaggaaggagggaaggcagaagagcagaaaagacttcttcacagcttactcacctatacctagaaatagccttctaagaatcttatatacacatccacttaaattttactgggtagaatggctcagtggccgactagaaaaagtagtcaaaaattgggcacccatcactgtcctgtgtaaaatcagattttttaattaaaggagattggtttattgcatggcaattaatctctgctactgtagagatattattatggagctcttctcataaatagaatagagtccagacgtggtggctcacgcctgtaatcccagcactttgagaggcgggcagatcacctgagttctcgagttagagaccagcctgaccaacatggagaaaccccatctttactaaaaatacaaagttggacgggcatggtggcacatgcctgtaatcccagctacttgggaggcagaggcaggagaatccgggaggaggaggctgcagtgagccgagatcatgccattgcactccagcctgggcaacaagagtgaaacttccgtctctgaatgaatgaatgaatgaatgaatgaatgaatgaacaaaaagaataggagaccccaaaaaggaagtgtcttggactggagaacttgttcatacagtgatagcctttattttcttatagaactgttaattgaaatagctaaatggcagagtagttgtaacagacattgttgagtgccattccaccaaatacatggcctgattgatgtttcagaatccttttcaagttatttatttatttatttattcaggacggagtctcactctgtcacccagcctggagtgcagtggtgtgatctcagctcactgcaacctctgcctcctgggtccaagcgagtctcctgccttaggctcctgagtagctggtattacaggagccaccgccatgcctagctaacctttttgtagttttagtagaggtaggatttcaccatgttggtcaggctggtttcaaactcctgacctcaagtgaccaacctgcctcatcctcccaaagtgccaggattataggcgtgaaccaccacgcccagcccttttaaggtctttttgacaagttattttagcacagactgtgtcttaattttacatatccccagtcttactcatttggcataaatgttttttctgaagattggatttaatttctatgctgaattttaacaatatgattattgttaagatagggcagtcctgaatctaaatgaatctatttagatttcaaaaatgtattcagtcagtggccccagtagtaatgatttttgatggaatatattaataattgatttttaaaatgatagccttttttgacataatgtaaacatatgcttccgtttctttgtcaaatggggataatgagaatgctaaagcagctaggacagtatttgtcaaagttttggcattttgtgctggataatttgtttttcaggactgtcctggtgtggtgttgaagtttagtagcgtccgtagtctctactcactaagatgtcaatagcatcccctcatttgtaaccaacctgaagtattccctggtgggaaattgccccggcacacaatatctaataaatattacttatttgttttaaaatatatttttgatttattgagtgtttttggttcagctgtactgtagtttatcaaaatgcaagttttgggtagagcaaggacagcctggggatttatttttttaaaaaaattttaaaatacgttctcttgctgtgataaaagactgttgcatagctagtgttagagttaatctttagcttggacgtctctttaactgtgtgcttattttcttttaagatatactatgtagtgcaaaaagactcaagttgttaatgcagcctttgagttccatccatgtgagaacagaaactctagcattaacaaaactagaagtctggtggtatttactgatgagacttggacctcatcttcctgctaattttgaacaggtaacattacaagtgttgactatagcactttatgtttttgttaatgtgttcttaaattcttaccaatgtaatcctgtggtgttatttttgctatttattagcagactagaacatataaaaggtctttcactttactggcagagaacttaaattcatttcccacaagggatattgttcagttgcttgaaatggagcccctttacctgaaatgtttttatttatttattattaatttatttattttgagatggagtcttgttctgtttcccaggatggagtgcagtggcacgatctcggctcactgcaacctccacctcctgggttcaagtgattctcctgtgtcagtctcccgagtagctgggactgcaggcgcacgaccacacctggctaattttttgtattttttagtgtagatagggttttaccatggtggccaggctggtctcgcactcctggcctcaaatgattcgcccatgccagcctcccaaaatgctgggattacaggcatgagccaccgcgcctggccctgaaatgtttttaaattagcaagtactcaaacattcttactctacaagcattatgattttaaacaaagggttttttcccctagagcatttggaatataattgagaagaaaaccagcatcagtgaaatagaaatcagccgggcgcggtgactcatgcctgtagtcctagcactttgggaggcagaggcaggtgggttgcctgagctcaggagtttgagaccagcctgggcaacatggtgaaaccccgtgtctactaaaatacaaaaaagtagctgggtgtggtggcatgtgcctgtagtctcagctactcgggaggctgaggagaattgcttgaacccaggagatggaggttgcagtgagctgagatcacaccactgcactccagcccaggcaacagagtgagactccatctcaaaaaaaaaaaaaaagagagaaatcaagtgctacactgggtagatacaaggttggaccagttcttgtttttttatttcttgctccgttttctaggctgcatagtgataaccaatgactgaatcctatttataggttctttttaattgttacacaatgattttacgaattcttcaggatttgcatatccttactggcatttagatataaagtttaatcttaacctaaaccttttgagttatttgcagttatttccatccttggtttttgaatttttttttttttttttttttgagatggagtctcgctctgttgcccaggctagggtgcagtggcacgatctcggctcactgcaaactccacctcctgggttcacaccattctcctgcctcagcctcctgagtagctgggactacaggcgcccgccaccacgcccagctaattttttgtatttttagtagagacggggtttcactgtgttagccaggatggtctcgatctcctgactttgtgatctgcctgcctcggcctcccaaagtgctgggattacaggcatgagccactgcgccagcctggtttttgaatttttttacagttaaaaggagcagctctgctaacatctttttcatttctttatcacttattttggattttgggggtacattttacttctgggggtatattttaggggtatattttatattttatataaatagctgcatagcagggaatgcattcttggacaggaggacttataaatatacttaagccatttttattcagtttttaattttttaattattgagttttaaatttatataacatgaaataattgaagatgggcattgtcaacaatgtaatttgcatcataatgaattttccaaattctaccattataagggtccaataggctaattctttgcatttgtccaatacattaattggaataatttatttggtaactacatgtgactggtactaggatgatgttagaaatgagctttgtctgagttcatgttttccagagttttaaaaagttaaaattagtctaccagtaatgtgtacagttcagatgttgatgtatataaacaaatttaggtaatacatatttagggcaaatacagttgtaatgttcatattttttccaaattccactttttagcctgtttgtgcatggaaacgatctgtaaaatggaatatattaaggctccatttaatgaaatttatattatgtgaggcttttaaaaactgtgacagttgtatagtttatagatcgatgttttcttttaccccataggtttgtgtgcctctgattcaaagtacaataagcattgattctaatgcctcacctcagggcaattcgtgtcatgtagctacatctccaggtttaaatcctatgactcctgtacacaaaggtaagaggtagatattcttgttttttgcttttttaatcaggctttgttgacctagaagcatagttttgaagtaggaaaaaaaaaggctttgagaggttttgctcagtgtttttcgtttgaaatgaagcacttcataatttttaggttcattaccaaaaaatccattatcatgtttttctgttttttgttttttttttttaatattactgattactgttgtaagcgcattgttgtggttagaagagacggatgttttttcagtacattatgtgaggtgccttgcaaaaaaagcctcagagcagctaacatgaagctgttgattttagaaccagaatcttagcgctattaaaaacaacacatcggccaggtgaggtggctcacgcctgtaatcctagcactttgggaggccgagcccagcagatcacttgaggtcaggcatttgagaccagcctggccaacacggtgaaacccagtctctactgaaaataaaaaaattagccgggcgtggtcgtgggcccctgtaataaccagctacctgggaggctgtggcaggagaattgcttgaatcctgggaggcggaggttgcagtgagccgagatctcgccactgcactccagcctgggcgacagagtgagactcagtctcaaaaaaaacaaaataaaacaaaaacaacacttcagccaggtgcagtggcaggcacctataatctcagcatttagggggctgaggtgggaggatcacttgaagccaggagttggataccacctgtgctacatagtgagaccctgtctctacaaaaaatttaaaaattaactgagcacagtggtatccatccatctatagttacagctacttggaatgctgatgggagaagtgcttgagcccaggagtttgaggttgtagtgaactatgattgtaccactgcactgcagcctgggcagtacaatgagactctgtctcaaaaaaaaaaaaaaaaaaaatctcagcagttataaagtgtcttctttatgtatgtcattgaaagacatatgatatacatgtgtgtcatatgtattattttgtttgccatctgagtcttcaaaatttgttacagaatacctgcatattaatatttcaaggtatggattaatgcctgagacatttaaactctgtttttaaaagtttcattgaaatgaaatgtatgcatttgggtagctaatataaaatgagcttgtatgacttaactctttttttttttttcttaaaggtgcttcctccccgtacggagccccgggaactccccgaatgaacctgagttcgaatttaggtggaatggccacaatcccatccattcaacttttgggacttgaaatgttgcttcatttcttgttgggtccagaagccttgagttttgctaagcaaaataaacttgtgctgagcttaggtatttaaaggttttaagaataattttaattactaaaacagtctaggacttaatgcattggggtgaggagaggtgttattttgtcgcagccaaaatattttacagttgtgtatgaaatatgaatcttttttttatagaaaacacacctacttaatagacattttaaagttttatagtgagaaatgtatttcataaatctgttgttttacataattatcttttattcttccctttcagagccattggaacatccgttaatcagcagcccttcctttttttccaaacatgcaaatacacttatcactgctgttcatgatagctttgttgcagttggaaaagatgcccccggtaagagaatttgatttattatttgctcaaatgtgtgtttaaaaagaagaaaaaataggccagtcacagtacctcacacctgtaatcccagcactttgggaggccgaggtgagtggatcacttgagctcaggagttcgagaccagcctgggcaacatgacaaaaccctgtctctacaaagcatacaaaaactaggtgggcatgttggcagatacctgtagtcccagctactcgggaggcggaggcatgagaattgcttgagcccaggaggtggaagttgcagtgagccaagattgtgccactgcactgcagcctgggtgatagagcaagactctattaaaaaataaaaaatatgaagataaaataacaaatatttatatagtgccacctactggccagattgtgcattgagaactttacatttattcatttaattttcgcagtaacataccatgttagttcattttacaaatgagaaaatgggttatacaggaagtacataagttatgcagagtcacttacgagtggtagtaccgtgtcaagctctatggctctagcatctgtgcctaaactcctgtgttacatggcctatcaaataatgaggaaaggaaatttcaaaaattgtttgctctttaactggttggaaaaagaatcacaatgaatcacataaattttttctattggttgttagatatccttctgaatctccgtgaacaatctctgccccaaaagtagtgggcattcaattcagaaaagaaagataatttaaaaaaagataaaacaattacccttagttacacaattcattgttaacatgttatagttgttttaaggaacacatttatggctggacatggtagcgcatgcctgtaatcctggcagtttgggagaggctaaggtgggaggttcacttgaggcagatgtttgtgaccagcctaggaaatgtagtgagagtgctatctttacaaaaaaaaataattagatgggtgtagtggtgtgtacctatagtcctagctacttgggaggctgatgtgggaagactgcttgagcccaggttgttgaggtgacaatgagctatgattgtgccactgtactccagcctggacagagcaagaccctgtctgaaaaaaataaaccatatttagtttctacaaacaaaaacgaagtgatagtgttttataaacttactacagggttgagtatcatgaggaaaattaaattaagtattgttcaatttatttgtttaatgtaaggaagtaaagggagagtgttagtcatagtacgtagtcatatgtacttcatttaaaatactcaagtttattttgtttgacagatgtggttgtcagtgctatctggaaggagctaattagcttggtgaagtcagttactgaatcaggtaagcactattacactgatcaaatgttgttttttgaaacaggtggtgatcagatgatttttatagcatccggtgaattgtttgactatataaaatttattttaaaagtatttcttgcactaccgtagcttccagtttttaatttgtagttaatgtttgaagaacactggggttaggtgtgctgacccaccacatggtccaaaatctacatataacttcagactcccccagaacttaactactgataacttactatcgattggaagccttgctgataacataaatagctgatgagcacatatttatacgttatgtgcattatatgctgtgttcattaacaatattagtaaattagagaaaagaatgttaggaaaatcataagagaaaacataatcattaagtggaaacgggttatattcttgtctttatgttgagtacactaaggagggaagaggaggggtggaacttgctgtttccgggatggaagaaagtctgaataggagtggactcatgccgtccaaacccgtgtcgttcaagggtcaactgtacttagtattgttgatttagaaaaaataaatttttacagctctctgtatagtcatctctaaaattacatgcttagaaatacacccttctagccgggcgcggtggctcatgcctgtaattccagcactttgggaggccgaggcgggcggatcacctgaggtcaggagtttgagacccgtctgaccaacatggagaaaccctgcctctactaaaaatacgaaattagccagacatggtggtgcatgcctgtaatcaatccccagctactcaggaggctgaggcaggagaattgcttgaacctgggaggcggaggttgcagtgagctgagatggcgccattgcactccagcctgggcaataagagtgaaactccatcaaaaaaaaaaaaaaaaagtaaatacaccattctcagccaggcatggtggctgacgtctgtaatcccaacactttgggaagctgagatgggtggatcacctgaggtcaggagtttgataccagcctagcaaacccgtctctactaaaaatatgaaaatcagccaggcatggtggtgcacacctgtaatcccagctactcaggaagctgaggcaggagaatcgcttgaacccaggaagtggtggttgcagtgagccaaggttgtgcccctgtaccccagcttgggtgacagagcaagaccctgtctcaaaaaaaaaaaaaaaaaaaaaaagaactatacccttctttttgctttttgataggtaacaaaaaagagaaaccaggttctgaagttttgactctcttattaaagtctttggaaagcatagtaaagtctgaagtatttcctgtatcaaaaacgctggtaagtataatacccgtatgttggactttaaaaaccattttctgaagttaaattttatatagaagatatttgcacaaatctagtttgggaagacttttttatatcaagcattcatcagcagtttagtcctattgcaataagtgccattctattaactgtagagtcatttgaaacctttttaatagtgactataacaacagccacaaaagtcttcaacgtggtaagaaaaaagtatccgccatacagagaaaaactagggtaaaggacatgaaacttgaactgaagaaactcagatgtcctttaattttatgacaagattgctgaaaactactaatagttggtactttgttttcaattaactgtttttaaccaagataatgactttggtattaaaaccccttttttttttaaacccgtgtagtacaggaagaaaagtgaattggatatgattttgaggatatgggcatctcaaaataagctccagtggaacaaacaatacccttaaattctgattttgtttcctttatgtattttgatagttacttgttctgtagcagtatagcatagtggttaatagcaagggctctggagcatactaggttgaataccagcctaactattcattagctgagtaaatttgtgcagtttatctattcccttggctttgcctaaccccatatgtaaagagggaatgtagcagtagttaaagactaagtgaattgatacatggaaagtactatgggccaggaacaaactaatactgtctattattattactaatctgtttcaggtgacagtgtgtgaaaatgtattttcactgacataactcttctatgacatttaagttatgtagtgcatgttcataccagtatattaccactgggcatggtggctcacatctgtaatcccagcactttgggagggcaaggtgggcaaattgcaaaaattagccaggcatgctgacatgcctctagtcccagcttttatggaagcagaggtgggagaatcacttgagcccatgaggttgaggctgcagtgagccaagatcgtgccactgcaatccagcctggacaacaatgagaccctgtctcaaaaaagaaaaaaaagacagtatggtagtatttttggagagcaatttggtaggctcagtcagtttgatttagcaatcttagacccaactattagcagtcctttgaatatttgctttgggtaccagtataattaattgcagaatttctattagtagtataaaaaaacatagaaatagccccaaggtctcttaatagaaaaatggttgaataaataatggacattcatatagcagtatttttatatattgatgcaaaaattccgtaacaaggtaaaatgaaggttagttgcagagtttaatatcattagtgatttacagtgtaatggctttaatggtttaaaggaatgtgtgtataactggctgcccaagaagttgtgtgtttttctgtgtacttacatatacagaaatttagaaggtctaggaaaatagactctgaactgaaaatattatcgttggagattaaagactttacctgctttttatatttctgtgtttgaacttctaaaacggatgcagatatattcatgttagtgaatgaatgtatttgatcttttttaactaatgagattatatttacgttaatgaatgaacattacttgtaattgttagagatatagttaacactcagatttttattagataatatttttacggctaatttactgtaaaaccttttatctctcataggtcctcatggaaattacaattaaaggacttcctcagaaagtattaggttcaccagcatatcaggttgctaatatggatattcttaatgcaagtatcttaaatgtaatatgatgaagattggccaaaaacatttatacttcccttttttattttattttattttattttattttattttatttatttttgagacggagttttgctcttgttgcccaggctggagagcagtggcacgatctcggctcactgcaacctccgcctcccaggttcaagctattctcctgcctcaacctcccgagtagctgggattacaggcatgtgccaccacacccggctaattttgtatttttatagagacggggtttctccatgttggtcaggctggtcttgaactcctaacctcgggtgatccctccgccttgctcttccaaatcctgggattacaggtgtgagccactgtgcccagcatatttcccttttttttaaaaaaaaaaaaaaaaagaaagatgaccttatgtaaaattctgagagtattggatttgaagtatattgaccaaattaaaggaaaaactgatagttaatataaagaattaaatatgctgctatgtgaatgaaaaaactattttcctggattaaataaatggctccaaaaggaaagtttcctagttgtttatatacgataatactgttggttactgccataaatattggaagctaatgtaaaatgcacttagtatctctaggatataggcattgggattccagtaagttttaaatctatgttctttttatatctggaatctcataattccttgattttctgtgtagaggaaacagctatgattagactataaagagcttgattttttttttttttttttttttttgagacagagtcaggctgttgcgcagtctggagtgcagtggcgtgatctcggctcactgcaacctaattctcccggtctcatgccattctcctgcctcagtctcccgagtagctgggactacaggcgcgtgccaccctgcccggctagtttttttgtatttttatttagtagagatggggtttcactgtgttagccaggatggtctcgatctcctgacctcgtgatccacccgcctcggcctcccaaagtgctggcattacaggagtgagccactgcgcccggccaagagcttgatttttgtgtgcagtatatggaaataattttactaacatggttgtcataccctaagtaatgccaaaagttaaatttgtcatgctaaaacaattttatttcttaaataaccaattataaaaaacaaatgttctattctttgtaactgagaagattgacttcattttctccttcagggaactccagctttgttcttaattcaattaattttcaacaatttcttggaatgtggtgtatcagatgaaaggtaagtttgtactttaacttgaaactttgtcttggaaaggttatgtaatgaatgagattatttatgtactatttcataagtttaagtttttttaaaaaaaattcgttaactttttgtcagttattttagaattttgttaacattaaattaatatattcctgccaaaaagttgatgcattttttataattttttgttcaggttctttctcagtttggaatcacttgtaggctgtgttctttctggtccaacttcaccactagctttcagtgactcagttttaaatgttattaatcaaaatgcaaagcagttggaaaataaggagcatctctggaaaatgtggagtgttatagtcaccccattaactgaattgattaatcaggtatgaaataaatctgctacgtattttggataatagaccttttttttttgttagtgcagttggggaaatgaatagaagtttgaatttgaatagaagatggtaaatattttttctggtggaattggtaaacgttgtacttttgattgattttattgcatttctccctcactggtaaagaaactataacttaatggggactaatcagcttcattttcttcagtagtgattataaacctagaaggctcacatagatgtaaattcttgtatcttggattctttcagtagttttattaacagggaataacagcggttatcttgactaggctatatattcccatagttaagccacgttggtgattacctcaaagccatatagcatttccttaagtcaggaatctattgagagttgaataatctgtgtatttaaatacttaaatcctcaatgtttacctatttaacaaaagtgggtatagtggcaggctgtggggcacaagttctgtttatgatttgtcagcctctttgtcagtctttaaatgggaatatgcattctctgggctaatagtgctgtaactcaaaaatgaaataactcgaaggaattttgttgtttttgttgttgttgagttggaatctcactctgtcacccaggctagagtacagtggcacgatcttggctcactgcaacctctgcctcccaggttgaagcgattctcctgtttcagcctcccaaatggctgggactacaggtgcacgccaccaagcccagttaatttttgtatttttagtcaagatggggtttcactgtattggtcaggcggatctcaaactcttgaccttagcctcagcctcccaaagtgctgggattacaggcgtgagccactgtgctcagctttttacattatagttaacgtagcccttgttttggctactcaagctagcacactattcttctggaagaaaagtcatttacattcttaaatagctccccactgttagaatgatccagaggccctttttattgtatgagtttttgctggaatgctgtgtatgtatagtagaagactttggagttggccctgggattcatttttagaacttaaacatagtgcataatttccccagattgcaattaacaaattacagccaactggtgacttaaaactacagggatttattctctcaccgttctggagaccagctatccaaaatcaaggagttggtaggattggtttctcctggagctctgagacagaatctgttcatgcctctcagcttctggtggttgctggcaatccttgaccttccttgggttgtagctgcatcacttgactatgcctccatcttcacatggtattgttgtctgtgcctatccaaattttcctcttacagaaaagactgttcattggattggggctgaccctaatccagtaggacctcatctgaacatatgcaaagactttatttccaaataagactacatgcgtaggttcgaggggttaagagttaaacttattttgaatctcatcattggggaacacagttttgcccactacttataaataagttatgttactacttaggattagaataagatggtaatttgtctaacttcattatttttcttgttttagaccaatgaagtaaatcaaggtgatgccttagaacataattttagtgccatctatggtgcattgactttaccagtaaaccacattttttcagaacagagatttccagtggtaaggcattgtcaagtattgatttccgagggatttgtatttttctgaaaatattatttcatcctttataatcagcttccacaatgatttgtttttctttttctttttctcttttttttttgagacagtctcacattgtcgtccaggcttggagtacagtggtgcaatctcagcttactgcaacctctgccttctgggttcaagcagttctcctgtctctgcctcccaagtagctgggattacaggaccatgccactgcgcccagctaatttttgtatttttagtagaaatggagtttcaccatattggtcagtttcacctgacctcaagtgatccacctgccttggcctcccaaagtgctgggattacaggcgtgagccactgtgcccagcccacaataatttctaaaataagacttctttatgactttattactagcttaggagaatgatgaagggcgagagaagttcttttggatctttgataatttttggtatcatggccttatttcctctcttcagttagacctctgggatgtgggggaaaggttattaccctgtgttagtctcttttttattttgagacagtttcactcttgttgcccaggctggagtgcagtggggcaatcttggctcactgcaacctctacctcctgggttcaagcaattctcctacctcagcctcccgagtagctgggattacaggcatccgccacttcgtccggctgattttttgtatttttagtagagatggggtttcgccatgttgacctcgaactcctgacctcaggtgatccaccaacctcggcctcccagagtgctggggttacaggcgtgagccactgcacccggccgttagtgtcttttttgacacactaaatgttgcagtgtttttaaaaaatgttaaagatgtattgattctataaactttgatagataggtatatattaacaaaacttctttttttgttgttattggtaggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctgtgagtttgtcctgatgctacctttttttgtttgtttttaaaggattcttttcaagtaaatggagataatatttgtgaactgtcacctattactgcctctatttatatgtgataaagttgatactgcaaacaagtatgctttgtgtaacagttttgtgtctttgggctctaagattcagttttgggatcattaatagtgaagatcttttactatactgtgttatctccttgtgcttgtgtcattctagattaacacttcaagggccttgctctcctggacctcactttctcatacgtatctgttagatctttaaattcaatccctttgaaagtttgtagtcttagaaaatataagtctcttttctctttcttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggaccacaggcgtgagccaccgcgcccggcctctttctttccctcctcatggaaaggacagctgttgggaacagattgatatgcgtcattccagaatagacctctttctgtttacgcatgtcatttgtatattgatccttgcatatgcatttgaatatatggtattcttgccaatgaaatccttattgcatttattccaaagtaattatgtaacttttcgtaaaacactgtcttggctcagtttcaagtcaatccatatagctctattatttgtttcaactgctgtctagtattctgtagtatggttgtaccattacttggaattctattatttatttatttattattttttgagacagagtctcactctgctgcgcaggcttgagtgcagtggcacgatctcagctcactgcagcctccgccttctgggttcaagcgattcttctgcctcagcttcccgagttgctgggactacagttgcacaccatcatgcccagctaattttgtatttttagtagagatggggtttcaccatgttggccaggctggtctcgaattcttgacctgaggtgatccaccttggcctcccaaagtgctaggattacaggcgtgagccattgcacctggcctggaattctgttattttaaggacattttgtttttttctattatttattactgtgtatgatcctggtaatggccttcacacagaaaccgttgtttttccatgcagattattgaaatgatatttgttgtgcctgttttctctatagcttatatctaacacatattttaatgaggaataaaagaaagtaaaaataacagttctttttttttttcttgcccctgagacagagtctcacagtgattgttggacgacaacccaggctggagtgcattggtgcaatatgggctcactatgacctctgcctcccaggttcaagtgattctcctccctagtagctgggactacaggtgtgcaccaccatgcctggctaatttttgtatttttagtagagagggggtttcaccgtgttggccaggctggtcttgaactcctgacctcaggtgattagcccacctcagccttccaaagtgttgggattacaggtgtgagccgccgcgcccagccaaaaatgacagttcttattgtaaaagattacaaacaacaaagcaaattccccctcacacgtcttctcctcagtaataatcactacccatagttagatgttcattgttttagtgttttaaatggatttatatacatatcctctacttgttattagcacaattctaattgtatttgtcggagtgactttaaaaatgtaaatcagatcttgtcactcttgaagtattatagtgttttgttagatttggaataaaaatctgagctccttacactacccatgaggtttctgcttccttttccaaaggacttacctaatcgcgcttgtttatttttgttgtatagcatcttatttcctttttagtactgtctcgaaattgtttatttctgtactttattatgttatttcacccacactccatgaggttagggacattgtctgtcatgatggtgattatctctgggatctgtctactgaataaacaatgtgcaggtttttataactgatcggaagaaggttgaccctcagttatcacctttaaaaaatggtcttagttaggctttctccctttgttcttttccagaagaaacttggagtctgtcaaatttcacaaaataccctgttgagattttgcttggctttgataagggtgaattcacagattaattcggaaaagaatttacgtctttctaatcaaattgttccttccagggatttgtgtttatttaggtcttctaaagttaacctaacttgattattgtttttaagctgttttttaacattataaatgggtctgttcttccctcatacttgcttgttgctgaaggacataaaagttgttgcttacatacttccttgtattgaatcatgtgtttttgggatacacttcttggttacagtgctattcttttaaattatcataggattaatgtttttttctgcatgtatatcttcattagtgatattggagttctcattgttcaatttttgtattatggcaatagtgacctcttagaatgattcagaaaactgttcttcaccaatttatatagtgtaaaaggaatgccatatctacagttgtattctttttttctttctctctttttctttcttttctttctttcttgatgaggtcttgctgtgttgcccaagctggagtatagtggctattcacaggcaccatgcacactacagcctccacctcctgggttcaagcagtcatcctgcttcaacctcccgagtgggttggactacgtgatgccaagcccaccaacctttttgttctgaagtcttctcttttcttggttggacttggtaattaaaggcttatctaagtctaccaaggaaaacaacatgtagttttattttattgatcattactacacagctttttacttttctttgtctttaatacattgaatggttttgttttaaagcttttttcaaacatatgcatgtaagactttgattactgccatcagtgatcatatagactactttgatgcctttttttttttttttgagaccgagtttcactcttgttgtccaggctggagtgcagtggtgcgatctcggctcactgcaacctctgcctccgggttcaagtgattctcctgccttagcctccctagtagctgggattaaaggcgtgtgccaccacgcctggctaattttgtatttttagtagagacggggtttctccatgttggccaggctggtcttgaactcctgacctcaggtgattctgcctgccttggcctcccaaagtgctgggattacaggtgtgagccaccacacccagcctttgatgtcccccccttttttttttaatagcaccagggaacttggaagggtgctttgtaatttgagaattttttatggatatgtgttgctattttatcattaattttttattttactgtattgtgatcagagaggatcatctaggacttctaattttggaattcatcctgtgttataactgtgataatgtagttttataattgtttatttataagacacttgggatcaggtatctccctgattatgaatttgctgtatattaacatgtttattaaatactttgatgccatattgttatacattagagattaatgactactgatgttttcattgtaatgtgttccttgttactgcctttttcttaaattctactagcttgaaatttattacaccttcttgaaaatttgtgtcaaatgtgtctttaaaaacaccatcctgagcaataattctttctttttttttttgacggagcctcgctctgtcgcaggctggcgtgcaatggtgtgaactcggctcactgcagcctccgcctcccgggttcaagcagttctcctgccccagcctcccgagtagctgggattacaagcattcaccaccacgcctggctaatttttgtgtttttagtagagacggggtttcaccatgttggccaggctggtctcgaactccagacctcaggtgatccacccacctcagcctcccaaagtgctgggattgcaggcgtgagccaccagtcctggccagcaacttctttttatgttttgtttccactgggtttagtgaaaacttttacttcataattttcaagaggaatttgatagagaatctgtgatcctagtatttccaatctcagtttattggttgatatgatggcttttatggggatcttaaaagtgaattatttttcttaaatattgaggaagagaaagtacagtgtttgactcagcagttaactgaaaaagatttgtaatcatgtatggtcatgcgcctcataacaatgtgtcagtcaacaacagaccgcaaatctagtgctacatatcctaagcagaacgttataatacggtatttttactgtgtcttttcgatgcttagatacacaaatacataccattttgttacagttgcctagagtattcagtatagtaactacacacctatacaggtgcctaggctatgtgtttgtagcttaggaacaacagactatataggtgtgtagtaggctgtatcatctaggtttgtgtgggtacactgtgttctcacaagatgaaattgcctgatgacccatttttcacagtggatctctgttaagccgtgggtggctgcacttaatgtactgtaagctgtggcatgtgtgttacataggatatatgggagtaacagtcttatattttttcatgttgcttacttttgttgaatactgtcccagtacttgaatgtttctaacagtggtactttcttccctagaatttgttgttcgtggatagaattatttatattattactgtaatggttgattgcattgacttctcaccatataatattaaatatcagcccaaagttaaatgtaagtatgtattttttaacctttgtttgtccagtatttcataagcagtactgaactttgccaggggaagtcctaatacctttgccacctcattttactaacttttgatcttgtttaaccatgttagttactatgctaggagctttcatacatgttctctctcttttttctttttaattttcatatgctctgtatcattctcttatctctatcacacaaaatttctttactcctttttacaacgcagaaagataaatactattctaattagagattgcctaatagtacaaatggttttactcattccatctggtatgaaggattacctggacaagaaacttagacataacttaaaatgtttttatttgcaagcctgatttaaaatagtcattgaattgacattataatttaaaagaaaacaatgggatcagttaattggttatttttttccagaaatgttacaaagtttaactcatcgtttacctgaaacatggtaattaaatgattaaaattggacaattgggatcataacaagttgcgtgatttttaaaaccatatgccttggttagttttaagttattttgtagcaaatagtttttaaaatctgttaattgattcattgaagtcagatatatccacctatgtttatatgttcttaccatataggtagtgataatctgtcattaatgaaaaatgttagttgatgttgagatatattattcttgtttaaagattagggacataaaattatctaacaataagatttgccattgatgagttttctaaaacattcttagaatcttttttggtttttgaatttttactaagtagcaatatggagtaacatgttaagctcctgaagtatattataggtcagagcatcccggcctgagtgccgtggaaatataggttatagatgttcttgacatactgatcttagctctcctcttggtctgaccaggacctaatatgattacctcagtgtgtcagaaaaataggcttatctctgaaaatcataagtttaccaagattatataacagatgatgtcagaaattataagccactgaagtttcatagagcgaagatgatcagtctcattttgacataattttacctatgttggtacttctgaaattagatttaaccgaatatccaattcaggaacccacagttacaaatgtcttttccactccgtgtccatgcaaaacagagccagagttctcttgctgtaaaatttgggtaatggggagatttttaaaagaagttgagaagaggaaacaatgttaagactaaccgaaaggaaattgttattatcaggatcaccttgggattttttggtgacttacattgtgatgatttcaaatttagagaaatactgcaagagtttatgtggaaacttcgtattcctttactcaggtttctcaattaatggttgattgcatttatcttatctgctcccccctccccccagaatatacattttattctttttcccttctgaaccattttaaggtatagttttagacaagttgacaacctggaacagttcctcagtcttgtcttttatgtctttcaaaaaacaactttaggctgggtgcagtggctcacgcctgtaataccagcactttgagaggccgaggtgggtggatcacctgaggtcaggagtgctagaccagcctggccaacagggctacaacctgtctctactaaaaatacaaaaattagcaagccatggtggtgcgcgcctgtagtcccagctacttgggaatctgaggcaggagaatctcctgaacccaggaggcagaggttgcagtgagctgagatcatgccactgcactccaccagcctgggcaacagagctagactctgtctcaaaaaaaaaaaaaaaaaaaaaaaggcaattttactttcttagagtctctcaatctgggattaccatattgctttaagattagattcagggtccattcattactggagtaccacagaaataatgctgtagttctttttcaattcattattttcccattactggtgatgttaacacttcctgtttgtttgaggatggcatctgccaggttttccactgtaaggttaattactaaatacttactgtggcacaattattgcttgtttctctagatacactttcatttaccatctaatatcacatggattatgctattcattccttttctgtatttttctctactgtctctaatagtgagaaacctggttttcattaccctcaatgtatttacaacttgatcattcacttgtatgtaaccagtctcctgacataatggctgtcacctcacctcagcattctgtcagggaatttctggatatagtttttcagtgtacataaatgtctgaaaaattgattccaaggagaaagatcaacttccttttagtagcaacacttgtttttcatgttaccatatgagattaattttaattaagcattcgttttctgttaaatttgagatctcattccttaaaagaatggattgattgagagaaacaagtaattttggaatgggtaaattttttgggcaagggctatgtgggtttattcttctaggtagatgtttacagagggattatctaagggtacaaaaaatcagacagtacttttaggacaaatctttttctttatatctaggaaatagtagacttactgcattctttctcagctttgtatctctgacttgttcaatgttatttgtagggatcaatgtactatagatgagcaaaaaaatggtccgtcattcttagtggaaattttttgtttttaaaactaactttcaaaatttaaatttggaacctatcttatgtaatttggtactttcttgcatattagttgttgaaattttatgaaatgtaaaattaaagtttgagatgcattttataattcctaagaaaaaatgaacttgtttttctggaattcatattcatgatccgccaagtagttttcgtctcccattctcatttgtaaagataatgttctagtgatacttatccattaatggtacattatgttatgatttgtttggggtgtcagtcagcaaacggacatgtatttgatgtatctaacatttaaatgtgagctataaattgtaaaagtggacagtgactcctattttcaatttatttgagtttttaattaattcagtttttgtttttagcaccacagagaccttcagattggtccaaaaagaagaatgagcccctagggaaattgacttctttatttaaacttattgtgaaagtgatctattctttccacacactgagcttcaaggaagcacattctgataccctcttcactattggcaactcaatcaccggcattatttccagtgtacttgggcatatttctttgccttctatgatccgaaaaatatttgcaactttaacaagacctctggcattattttatgaaaactcaaagtaagtattttggactaagtagctttgaattaaatgtatacaatttaaatataggtagcaacttttattttttaatcagctgtgttgtagatggtagtcttgacaattttgtggagaggataataaactacacttttgttgaaaagatagttaaaatagtatagaaatatgagagagaaattggaagtctattttgcctgttacttccctttccctttgcttttcaatgcttaccttttcagaattgtttatgcaaacaagcatacctattaaatgcatgatagataggaaagcttacttggcatgctgttttgcaattaattatatggtatgcacttaatacagttggctgtttgtatccatgggttctgcattcatggattcaaccaaccctggatcgaaactatttagaaaaattaataaaatgaatgcaaataaatacaatatgacaattatttacattgtattagatattataaggaatctagagatgatttaaaacatatgggaggatgtgtgtaggttacatgcaaatacaatttgttttatattagagtgttgagcatccatggattttggtatcttggcaggagggtggtcctggaattagccgccaccatgcccagctaataccccatggatactgagggatttctgtccttgtaccatatacatgagaatctcatttttaaaaatgtctacatgtgattctgttaaactttttacccaatttctgattggtggacatacatgtttttctagtgttctccctcataacaattgaacattatttatacgtaaatcattgcccacatttgccactatttctgggtatacacatttatgtgtctgaattggtctccaaaaaattgaattaattttgcatcaccctttatttgaatcgaagcaagcagtgctttaaaacctgaaagaaaaaaaaagcctcagtaacaaactcgtacaagcattttgaaaggattcatgaatattctttatagcaagcttgtgtggttcattcagaagacagtttatctttcataaattaacaaagttttaggaacagattttataaagtacgatacaacctccaaatccatgaacttttctttgcaaatctttaagtctatatttcatcaaaagtaatgcctaaaagaaatgtacagaaacaagcagttaatatgattattactttgaggtttattgtagatattttctgtgattcatttttcaaagatgggatggttttatgcttaatatttagtatttgagttttttacttgttaagtctttgggcacctttttatatcatcaatttatatttattatgtctttattacctttttcttaggattagcttgatagatagtacagtgttaacttgcagaaatataaatggtattctattttatccttcctaggcttgatgaagttcctaaagtatatagttgtctgaacaacaaggtaaaaatagacaattctccataaaccatactttcatgatgagaaaatgatagagtttagataattttcttaaacataattctgctgatttttaaaggggttattccttctttctttctttttttcctggagacagcattttgctcttgtcacccaagctggagtgcagtggcaggatctcggctcactgcaacctccacctcctgggatcaagtgattctcccacctcagcttcctgagtagctgggagtacaggcacatgctaccacacccagctgattttttgtgtatttagtagagacagggtttcaccatgttgggcaggcttgtctcgaactcctgacctcaagtgattcgcctgcctcggcttcccgaagtgctaagattacaggtgtgagccaacacgcttgtcctgttcttcatttttaatggacatttaataacaccatatgaacacatttatagggtttttttttttttaaggatttaatactttaaattcatgttaagtaatgaacttttttttggagacaaaatctcacctagctgggagtgcagtggcacgatcacggcttaccacacccctgccctcctgggctcaaggtgattctcccaccatagcctcccaagtagctaggactacaggcatacaccaccactcctggctaatttttgtattttttgtagaggcggggttttgccatgttgctcaggctcgtctcaaattcctgagctcaagcagtctgcccgctttggcttcccaaagtgctgggattacaggcgtgaaccactgagcccagcctagttaatcaactcttagctcatccctttgtatatgatggcgattggacccaaagttttctaggtgaacgtatgtaggtaactatttatcttgttataattattacaaaaacataatttcttttgttaatagaaaataagttcaaaattgaactgtaatattaataaccaaagcaaattcacctgataatttgtcgagttataaagagggatatatatttaaggcaacagtgggggttagtttaaaattgtcttaattttaaaaattgaaatagcaacatatattctgtgagttaatatttagtatatgttttgcttttattttttcgtttttcctagttagaaaagctactgggagaaattattgcttgtctgcaattcagctacaccggaacttatgatagtgaacttcttgaacaactctccccactattatgcataatatttctgcacaagaataaacagattcgaaaacagagtgctcagttctggaatgccacttttgccaaagtgatgatgttggtttatcctgaagagttaaagtatgctaacaacaaaacttatatacaactaactattctgttgtgatcatataaattgatactttgattcaaataatcttttcttatggggtattgttacagaggattccttagttgaaatattaccatttggaatacatgataattattaaacattatttcaccttttcattggtgcttagaataatcttgatttcaggagccaagaaaagcagtttaaattatccttaataaaagagacaaggaggacaggaaatagatgattttttttttttttttttttttttgagatagagtctcactctgtcgcccaggctggagtgcagtggtgcgatctgggctcactgcaagctctgcctcccgggttcaagcgattctcctgcctcagcctcctgagtagctgggactgaaggtgcgtgccaccatgcctggctaattttttgtatttttagtagagacaaggtttcactgtgttagccaggatcgtctcaatctcctgacctcgttatctgcgtgcctcagcctcccaaagtgctgggattacaggtgtgagccactgtgccctgcctggataattattaaagctagacatgaatactttatataatattctacttcttattggaattttccatgataaaaatttggaattcagaaaagtacagggaaaaatataaaaattgcctaatttttctcagttttatatacacatagtaaggaacagtctttatttaaaaataaagatgtattttgctgctctaaaaattaaagtgctgttgttaacagatcatcagtgttcaccagtactacttgacttaaggtatatattttatgtacttttttaaagaccagtactaacacaagccaaacaaaaatttctgctcctgttgcctggtttggaaactgttgaaatgatggaggaatccagtggaccatattctgatggagtaagttggggggttttattgttcatttgtttttggacatttaagttatttgttgaaagttataaataagtagaacctgaacagaaaagagttttgtaacataggctttttccacattgtcagtggtgtggcctgaaatttcttttgtgatttttcactagagattctcatgtaaataatctctaattcttgtcattaatcatttgttttgaactcgggtacctcatctgtgctgttcacaaagagtaaaatacataattgttgctttggaaaaactggaaataatggttactaagccatatctaagccagagctgctgttcattttcttatttttaaaaaattgattttctcaattcttctatcaggaaaataaatctttgctgtcacatggcattaggagcaaagtttctttggctaataatatttgattactgcctgaagatatagtagttaaaggcacgggtactatagacttgtgagctagagtgttcttagaaaacctttttctattcaggagcagctagggtatagctaattttgtttagaatctttgggagaaaaaagactgttatagccaactaagtatctcatttgcttttggctgaagtaaaaattttccactagataactaacagacttgtgaaagagttcagtggaatgtggtctgtaaaagctatatattctgttgaggggaaatatgctctgtcatacatgctttattaaccctcagttgtttaatgtttaaagttctatggctttgaatattctcttagaaatattttcagttacaggtagagtgtttgaatgtagtaatttaattcactttatgtgtttatgtgacatgtctcattttcagaattcataaaattgaatggtattaaacagctactattaaagagacaccaaagccatttgctgttgaattagacagtggctttcctttctttgatttttatgggattgaataattagaaaaattttgacaatatttgcaattactatttattaggaattttcaaaacgtgaaaaggaaaagcaaaatattaccgttctatttaatgaaattgtttcatttttaataaaacagacagaaaattcacaactaaatgtgaagataagtggcatggagagaaaatcaaatggaaaaagagattcatttttggcacaaacaaagaataaaaaagaaaatatgaaaccagcagccaaagtatgttttcaaaagtttaatcaaaaattttaagataaagtatattgtaacttacatacaactttaaaaattggatgaaagaactataaaagactaaataaaggttgggattgcaggggaattgagggcatttgatgtagaaagactgctaggatagcatggtaacccagaagccttgggtgatgattcctgtttaggaaaggtaagtttctgtgtaatgcttagcaactgttacatgtagttattccaggcagcagcccccttgagatggaatgagactagttatgaatgactaacataggtagcacaagagaaaatattttagaacttttgtttaggattattgttattttagaacttaatattttgaatagaaataaataatgcctagataagacacctatgttcttatcaactagctcatgctagttgccagttaacttgacttttagacaacagttctctcttccatgacctccagtaaaggttattctagaatcttgagaccatggccctggtgaaatgaaagaaaagtgttattttttaagaatacctctgccacattcttgtagcaactataaatagaattaaagcaatggttccaatgaacatttattaagataatattgtagtaccaaagttacttgtatgtagggcattttgtattggcgactttcactaagtcatgcctcaacttgagagctgcaaatatactctcctcctgccaaatcagttcatttccatgtgttagcctgacagacggttttgtccatactttgtagttaagcacagacttccctacttcgtaaagaggtttaatactgtctactttcttagtatttattagaggcagaaagaaagtggggaacattgtactaatttgttacggatcatgagtatcatcaactttcataatcactattgaaaaatggtgtcattattagaggagagtgatagaaatattggaaaataatttggaagctaaaatgtacatttgcttattttttcaaatctgcagctgaaacttgaatcttcgtctttaaaagtaaagggtgaaattcttttggaagaggaaaagtctactgactttgtgtttatacctccagaaggaaaagatgcaaaggaaagaatattaactgatcatcaaaaagaagttctcaaaacaaagcggtttgtaggccttttatcttgagttgggtatttggtattcaggcttagatttcatgcaagaaaagtgtaactttgtgtttagaactaaaatatgtgtactaattttttttttttttttttgacacggagtttcactctgttgcccaggctggagtgcagtggtgccatctcggctcactgcaagctccgcctcccaggttcacgctattctcctgcctcagcctcccgagtagctgggaccacaggcatgtgccaccacgcccggctaatttttttgtacttttagtagagacggggtttcaccatgttagccaggatggtcttgatctcctgacctcgtgatctgcccacctcggcctcccaaagtgctgggattacaggtgtgagccaccacacccggccacgtgtactaaattttaatgcgaaaagttatactttacataaatgcatttcataatgtataaagctacctagtaatgtaccaaatatttataaactgaatttcttctctgaggtgggaaatacgcatttaggtcatgattttataacaatttagtagaactgtaattttcgtttctttttatgttttgttttatgttgttgagacagagtctctctctgttacccaggctggagtgcagtggcatgatctctgctcactgcagtctctgcctcccgggctcaagtgatcttcccgcatcaacctcccaagtagctgggactgcagatgcacgccaccatgcccagctaattttttattttttgtagagataggattttgccatgttgcccatgctggtcttgaactcctgagctcaagcagcccacccacctcaacctcccaaagtgctgggattacaggcgtgagccaccgtacctggccataagtttaatttctaattgtaagaatatcatccggtttttgaagttacttatatatagtttttttcaggtgtgatattcctgccatgtataataatctggatgtttcccaagataccttatttactcagtatagtcaggaagagcctatgtaagtacagaagccatcaaacttttatatctgttttattcattttcaaataattataaaaataatattcttactaatatttatttcagggaaattcctactttaaccagaaaaccaaaggaggattctaagatgatgattacggtatgtttgacatttcatattttgggctttttagaatcacccttccattatacagtctgttaaactgctgaaatgtctgtaggtcttccctttattaattttaaaatttattgtagatttattgtatgatttccttttaactcccattcagatactagcagaatatcagcagacactagtcagtgtgtgtgtgtgtgtgtgtataaaataaatgtacttggcttttcttgaatatttacaattaggaacacaaactgttaggtatctaccactaactttggaatagttgccatatattgaatgtcagtgattatctttgggttaccgaagttttacactaaagttttcccagaaagtcaaactcgtttgctggttattaatctgtgtgtgtatatatatgtatatatttctgtgcaggaggagcaaatggacagtgacattgtcattcctcaagatgtcacggaagactgtggtatggctgaacatcttgaaaagtcctccctttcgaataatgagtgtggttctcttgacaaaaccagtccagaaatgtcaaacagtaataatgatgaaagaaaaaaagctttaatttcatcaaggaaaacatcaactgaatgtgcatctagtacagaaaattctttcgttgtcagcagtagttcagtttctaataccactgttgctggaactcccccataccctacaagtcggaggcaaacctttattactttggagaagtttgatggttcagaaaatagaccttttagtccatcccccttgaataatatttcatcaactgttacagtgaaaaataaccaggaaaccatgattaaaacagattttctaccaaaagcaaagcaaagagaagggactttttcaaaatctgattctgaaaaaatagtgaatggaactaagagatcaagccggagagctggtaaagctgaacaaacagggaataaaaggtctaagcccttaatgagatctgagccggagaaaaatactgaggaatctgttgaaggcattgtagtcttagaaaataacccacctggtttgcttaatcaaacagaatgtgtgtcagataatcaggttcatctttctgaatctacaatggagcatgacaatacaaagcttaaagcagcaacagtggaaaatgctgtattattggaaactaatactgtagaggagaaaaatgtagaaattaatttggaatccaaagagaatacacccccagtagtaatatcagcagatcaaatggtaaatgaggatagtcaggttcagataactccaaatcagaaaacccttagacggtcttcaaggcgacgttcagaagtagtagagtctaccactgaaagccaagataaggaaaatagtcatcaaaaaaaggaacgacgtaaggaagaagaaaaacctcttcagaagagtccattgcatataaaagatgatgtgttacctaaacaaaaactgattgctgaacaaactctacaggagaatttaattgagaaaggaagtaatttacatgagaagactcttggggaaactagtgctaatgcagaaactgaacaaaataaaaaaaaggcagaccctgagaacattaagtctgagggggatggtacccaggacattgtagataagtcctctgagaaactagtcagaggccgaacacggtatcaaactagaagagcatctcagggtttgctttccagcattgaaaactcagaatctgatagttcggaggcaaaagaagaaggttctaggaagaagagatctggaaaatggaaaaacaaaagcaatgaaagtgttgacattcaagatcaagaagagaaagtggtgaaacaggaatgtataaaagctgaaaatcagtcacatgattataaagcaacttctgaagaagatgtaagcataaaatctccgatttgcgaaaaacaagatgaaagtaatactgtaatatgtcaggattctacagtaacttcagatttgttgcaagttcctgatgatttaccaaatgtgtgtgaggaaaaaaatgaaactagcaaatatgcagaatattcctttacaagtctacctgtgccagaatcaaatctaaggactagaaatgccattaagagattacataagcgagactcttttgataattgtagtttgggagaatcctcaaaaatagggatatcagatatttcttcgctttcagaaaaaacttttcaaacacttgaatgccaacacaagagaagtaggagggtgaggagatctaaaggttgtgattgctgtggggaaaaatcacaacctcaggaaaagtcactcattgggttaaagaatacagaaaataatgacgtagagattagtgaaacaaaaaaggcagatgtgcaagcacctgtaagcccatcagaaacttctcaagctaatccatattctgaaggacaatttttagatgaacatcatagtgtgaattttcatttgggtctcaaagaggataatgatactattaatgattcattaattgtttctgaaaccaaatcaaaagaaaacactatgcaagaatctcttccttctggaatagtaaactttagagaggaaatttgtgatatggattctagtgaagcaatgtctcttgaaagccaggagtcacctaatgaaaattttaaaactgttggcccgtgtttaggagactcgaaaaatgtttcacaggaatctttggagacaaaagaagaaaaaccagaagaaaccccaaaaatggaactgagtctagagaatgttactgttgaaggaaatgcatgtaaagtaacagaatccaatctagagaaagcaaaaactatggaattgaatgtaggaaatgaagctagctttcatggacaagagagaaccaaaactggtatttctgaagaagcagcaatagaagaaaataaaagaaatgatgactctgaagcagacacagctaaactgaatgccaaagaagtagcaactgaggaatttaattcagatattagtctttctgataatactacacctgtaaaattgaatgctcaaactgagatttctgaacaaacagcagctggggaactagatggaggaaatgatgtatctgatctacactcatctgaagaaacgaataccaaaatgaaaaataatgaagaaatgatgatcggcgaggcaatggctgaaactggccatgatggtgaaacagagaatgagggcataactaccaaaacctcaaagcctgatgaagctgaaacaaacatgttgactgcagaaatggacaactttgtttgtgacacagttgaaatgagcactgaagaaggaatcattgacgctaataaaactgaaacaaatactgagtatagtaaatctgaagaaaaattagataacaatcaaatggtaatggaaagtgatattttacaggaagatcaccatacttcacagaaagtggaggaaccatcacagtgtctggcatctggaacagctatctctgagctaataatagaagacaataatgcatctcctcaaaaactaagggaacttgatccttcacttgtgtcagcaaatgacagtcctagtggcatgcagacacgctgtgtctggtctcctttggcttctccgtctacgagcattttaaagagaggactaaaaagatcccaagaagatgaaatctcatcacctgttaataaggtaaggggaatgaggctaaatattaaggaacccagtatttggttgggatattttggccatacagtgacctctggtgaatgacaaaatattacaattatatggccactcatttgattatttaccataatggttgctagggaaaaggtaggtagaagaaaaggtttcgaaaaaaggagactgaagccttttagataagtctttcattttacaacactaaagatctttatgcagctgtgcacattgttcacctttggcaaaattgataaggctcctagcatcttttctgctccccataccataatatcatatgaggaaacagatttaggaatgcaggcaacactgccattgataaagcagatttagtagttgtgtgttggaacattatgctgttttacgttttacatacatgttccagaccatatctaattaaaaaaaaaaactcatgtgccttcatcaacttgtagatgtgatcttatttagttatttatatccccatttcctcagctaaattatagatcttttactttagaaaagatggattatctatatatctgctttagcttcaggccttgtgccttgcacatagtttgttgaatgaatgaataaaaaaataggaaaagttaaatgtatttacgtaactcaacttgtcttatacttaacaaaatagatatcctgaaaaggtatgatgttggcattccttaattttgaacttgaacctgctattcattgtagaatacattttatatatacaagcatgaatatatagacatgacaccttgttttttgccttcaacaaacaacactttgaaagtattcctttggccaggctcggtagctcacacctgtaatcccaggcatgggatttgggaggccaaggcaggtggatcacctgagggtcgggagttcaagaccagcctgaccaacatggagaaaccccatctctattaaaaatacaaaaattagctgggcctggtggcgcacacctgtagttacagctactcaggaggctgaggcaggagaattgcttgaacccaggatgcagaggtcgcagtgagctgagattgtgccactgcactccagcctggcgacagagcgagactctcaaaaaaagaaaaaaaaatgttctttcaaaatccctgttactcttattcatgtgtctgaactttgcaagatacactgaaaattcttctgctgagaatctagagattaagttgttttttgttttgtttgtttgttttttgagatggagtcttactctgtctgtaagacagagtagtgcagtggcacgatcttggctcactgcatgctctgcctcccgggttcaagcgattctcctgcctcagcctcttgagtagctggcattacaggcatgtgccactaagcccagctaatttttgtacttttagtagagataaggtttcaccatgttggtcaggctggtcttgaactcctgacctcgagatccacccgccttggcctcccaaagtgctgggattacaggtgcgagccactgcgcctggcacatttctgtttttacatcagtcttctttctagtctggtaatcccataaagttcctagaatcagatcgtacacttttaactgccacatctggcttcgttaagtttttgttactgtgcctttttcacaatctttggtattatgcagagacagtttaaaatatagaaaattagagtgaattgtggtattgagttaatgtgatctgtgaaggcagtcgctaggaactgtgcagctgacttctggtgaaataaattttctaaacccacattctatttttgggtaacctcataatgaaaatttatggtgtaattttttaaaaactttaattttgttaagtaaaatcctgacctgtgttttcaggttcgccgtgtctcctttgcagatccaatataccaagcaggattggcagatgacattgatagacggtgctctattgttaggtcccattcttccaatagttctcccataggaaaaagtgttaaaacttctcctactacacaatctaaggtaagctataggctttaaaatatacatatatgtataccgacacagaattacatgtacatgatgtgtcataaaatgaactatatatgtgaaaaacttcttccttggtttaaaatatattcttttgtctggtacacggtaagcagaaaggaagagaagcagaaaggtaagaggcagtaatgatccagcaagtaattgattaggtagtagattactctttttatgttttttgaacttttaaagaaatgattgcagtctaagttgtaaaaattgtgaaattatagtcatctagggttctgagtgtttttttctctcctttcttctatctagcataataccacttcagccaaaggatttctgtccccaggatcacgtagccctaaatttaagagctcaaagaagtgtttagtaagaagtgctttagttttcatgtcactttatattttcatgttcagtcagttgacctctgtgtaacagcttctgaaatttattctaagatttcagaaatggccaaagaatccataccatgcccaacagaaagtgtttacccaccattggtgaactgtgtggcaccagttgacatcattttacctcagattacatcaaacatgtggtaagtggttatttaggcttcttgcttatattccaagatgccacttatttaagaggacttatctgattgcttggttctcatgtttagaattgattggcatgtactctcacacacattttatttttgaaataaaaatgcaactgagaaggtaggccagataaggcaatatgaaaaacatttagtatagtaagatgtatgcataatatttcaggtgctgcattgaacccttatatcattatcttgtttaatccaaatataaaccttatgaggaatatgaatatcatttctactttataggatgaagtttacaaagattaccagcaaaaccacacagctgttaagtcatcacatgtaagaagcatgagactcacatacataaaacttgttcatcagctgttttgttttgtttctaattacaagtttgtttccttgatgttttaagtcttggaaacttaaatgcgtgcatgtagatcgttcactatatcttgattaaaagaattatttcaggtagtttgtgatgccttgagatagtttctctttaactgaattatcaagctgccctgtcgtagcataatccccaataggagatgaagtattcttaaacttctctgaggaatttaatgatgcagtaatatgtatcagacataccaagtccatttctgattaaagttggggaggggattatgtgtacttaagaattatctattaatgagatgtatgtagaagcacaaggcacgcagtgggctcattcagttgccagtactgttgcttataccagacatacacatcagattcgaattttgttttaaattacacatacatgtgcctgtcttcactgtgggctaacctcagttatgattgagcttaaatggggaaattgaactggataaacccttgcaaatagcatataaataaaactatataattataatttcctgtttctgttttgtttagggcaagaggcctgggacaactcattagagctaagaatataaaaactattggtgatttgagtactcttacagcatctgaaataaaaactcttcctatccgttctccaaaagtgtccaatgtaaaaaaggctctcagaatatatcatgagcagcaggtaaaaacttagatattagctatgatgtatattaataaatgatgtagcagtacagttacagaagtttgttaaaagatcacttcataatggcacagggaaattgattcatttattttgtactgtctttatgcattgcacctcagataaatttttaaattgttttttcattaaattctgttcatccccttctctctttcatttccaccattcggtatttgattccatggctgctactgctaaaacctagatgttcaaatccaaacatctaccaaaaccatacagatttgtaggtcacagtattttggtttggatgcctaccacatttgtgacttatttttcttatttttcctttttgtcagtattgtgcatatgaacattttgggtcatgggcatttttcaagattctgatgaaagctaagattcttccctgctgtaaaactatatagaaaattttgtatataatttcagaaggattcacagactactgaaacccattcagagaccctctatccattgacactacaggttgagtattccttatctgaattgcttaggaccagaaatgttttggacttcagatttatttcgattttgagatatttgcattatgcagctacttgccagtttagcagccctaatctgtaaatccaaaacgctcattagagaatttgggcatcatgtcagtgctcaaaaagcttcaaattttggattccattccatccaaaaaagattccatttttggagtaggcatactcaacctgtatcagaagttttgaataaatgaaaaatagaataagcagtgttctgaatcagaatttctcagacctggggtttgccagccactgaagacttctgctgtattcttgaaggtccttgattttatattaacttatttgtgatcttctaaacattcattaactggttactcagaaaaccaatactactagtaattttctgtctcacagattgaatttagtttctaaagtattttcttactcagtttccatgggtcttgggaaagtctatgagaattaggttttttttaacagcttcattaagatatgatttacatcgtgtaaaattcacctaccctatgggtgcagttagtttttaatatattcacagagttaaataatattccccatgatctaattttgaatctttttttttatcacccagagaagaaacactgacccattagctatcactcctcatttccactgtccagccaatgcctacttttcctctatagatttgcctattctggatatttcataaaagtggggtcgtacaacttgtgatcttttgtgaatggcttctttcacttagcataatgttttcaaggtttatcctcaaaaatttccgttttgaggttgaataattctttgtagattctggatattagccttttgtcagatgagaagattgcaaaaattttctcccattctgtaggttgcctgttcactctgatggtagtttcttttgctgtgcagaagctctttagtttagttagatcccatttgtcaattttggcttttgttgccattgcttttggtgttttagacgtgaagtccttgcccatgcctatgtcccaaatggtattgccaaggttttcttctagggcttttatggttttaggtcttacagttaaatctttaatccatcttgaattaatttttgtataaggtgtaaggaagggatccagtttcagctttctacatatggctagccagttttcccaacaccatttattaaatagggaatcctttccccatttcttgtttttgtcaggtttgtcaaagaccagatggttgtagctgtgtggtattatttctgagggctctgttctgttccattggcttatatctctgttttggtaccagtaccatgctgttttggttactgtagccttgtagtatagtttgaagtcaggtagcatgatgtctccagctttgtcttttttgcttctgattgacttggcaatgcgggctcttttttcgttgcatatgaactttaaagtagttttttccaattctgtgaagaaagtccttggtagcttgatgggggtggcattgaatctataaattaccttgggcagtatggcgattttcacaatattgattcttcctatccatgagcatggaatgttcttccatttgtttgtgtcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattgatgtatatgaatgcttgtgatttttgcacattgattttgtatcctgagactttgctgaagttgcttattggcccaaggagattttgggctgagacaacggggttttctagatatacaatcatgtcatctgcaaacaggaacaatttgacttcctcttttcctaagtgaataccctttatttctttctcttgcctgattgccctggccagaacttccaacactatgttgaatagaagttgtgagagagggcatccctgtcttgtgccagttttcaaagggaatgctttcagtttttgcccattcagtatgatattggctgtgggtttgtcataaatagctcttattattttgagatacgtcccatcaatacctagtttattgagagtttttagcatgaagtgttgttgaattttgtcaaaggccttttctgcatctattgagataatcatgtggttttggtctttggttctgtttatatactggattacgtttactgattgtcatatgttgaaccagccttgcatcccagggatgaagctcacttgatcatggtggataagctttttgatgtgctgctggattcgttttgccagtattttattgaggatttttgcatcaatgttcatcaaggatattggtctaaaaatctctttttttgttgtgtctctgccaggctttggtatcaggatgatggtggcctcataaaaagagttagtgaggattccctctttttctattgattggaatagtttcagaaggaatggtaccagctcctctttgtacctctggtagaattcggctgtgaattcatctggtcctggactttttttggttgaataatatgcattatatgtatataccacattttgtttatccagttgacagacatttgggttgtttccaccatttgctattacgaataatgctgctgtgtctgcaagtttttatatggatagatgatttcatttctcttgtatatatacctagaagtggaattgctgagtcatgtggttactgaacttattattttcagaaagttaactttctgaacttagtattttctcaatcagtggtccatacgtcctaggaacacttaagaaaattgtatccttttttttttttttttttttttaaatacagtgtcactgtcacccaggccagagtgcaggtggggcatgatctcggcccactgcagctgcacctcctggactcaagcagttctcctgcctcagcctcccgagtagctgggattacaggcaccgtaatttttgtgttttttgtagaagggggtttcactatgtttgccaggctggtcttgaactcctgacctcaagtgatctacccaccttggcctcccaaagtgctggaattacaggggtgagccactgctcccagccagaaaattgtgttcttttttttaaaaaaattctatattttatttaagcttggaaatctctggtatagacttttttataccacattcttaaacttgggaaatagaatgtaattttcttagctgccatggctatatttcctgagaaaaccattatgaaatattgttaaattctaaccctctctttgaggaaatactttgtaatgctttattttgtgtagttagaacctactttcttagcagtattagctcttaattgtgatgggtggtagaacataggttctatgcaatgttttccagtgtttgtactattactcctattaaaagtaaagtttcaatttgttgttgttgttgttttgcgtttttttctgctccaactgtaatcaaggtgaagactcgtggactagaagagattccagtttttgatatttctgaaaaaacagtaaatggaatagaaaataaatctttgtcacctgatgaagaaagacttgtctcaggtatattttagcaaaagtgggataattttatttagaagatcagctgactttcttgaaatatgttattttttttagtctgatttgaccatgccttatttcaacaattattttatgtttaatgtgaagtatatgaaaaactaaccgattggacatcaaatgtgtctacttgtttttcttgtcaacttctccatcaaggtctcaaggatttaaactatacactttctcttctagttatattaataaatgaagtagtctaccatttttaaatttctttaatagcacagaataatctatgagaatagcacagaataataagcagtggtaggttgggtatggtggctcacgcctgtaatcccagcactttgggaggccaaggtgggtggatcgcttgaggtcaggagttcgagaccactctgggcaacatgaaacccagcacctactaaaaatacaaaaaatagctggatgtggtggtgcatgccagtaatcccagttacttgggaggctgaggcgggagaatggcttgaacctatgaggcagaggttgcagtgagctgagattacgccactgcactccagcctgggcaatagaatgaggctccatctcataataataataagcagcagcggcagctctggtagatttttttgtgtgcttgtcctcatgaagacttaagcctgctctctcaatttgaaacctaggcacttggactaacttaaaagatcatgtaaaaaatttaatttttgtctggtatagatttaattgtggttttttttttctcttttagatataattgatcctgttgctttagaaattccattatccaaaaaccttctggcacagattagtgctcttgctcttcagctggattcagaagatcttcataattattcaggaagccaactatttgaaatgcacgagaaactaagttgtatggcaaactctgtaataaaaaatctacagtcacgttggagatcaccatcccatgaaaattctatttagtattttcagagaaaattgaaggtttttttaaacatcactggatttcttgattgaggaaacaagttctgaaataatagcacaatttcaaagaagagactctttgcaaagttgataacatttcaaaccctgaaggacagtgacttattatgtaagttcaattttgtaagttcattatgtaagatccttttttttttcataatatgtattcttggctgctatgcgtggtttttcaggaaatttaattatcttactgagatgtgaaagcaaaactagtaacagaacttacattttatttcatgctttcttaaacccgtgcatattctggtgaaacatgtaaaatactttaagtaaaattgaacatttttatttgaatttttgctgaactgataaaggtgtttatatttttgtttgttggtttgtttaattcatgtttgttgggactgaggtttaggaagtttgttactggttaaaaacctcaaatgaaatgcgaaagaatttgaatttttcctgcatatgtcaactttggacagctttcaagaaaaatgagaaaagtttcaacttctggcggttaaaatattaatgcagaatttactaagattttattcatttgcattagcaaatattcatgcagcagcagttgactgaaaatttattcttatgagacgtatagtattcatttttaaatgcatgattgtacattatgtatagacgacaatgtttttaatttataaatttcattctttgttaattgcatgggtttttctgcagcttattgtgaataccttggttctgttcaatagaaacattttgtatatattaaatactgaaatatcagtatcgacggtggaagtgcttcatgggcttgctgcacatatttgtaggatactgtatctgcaaatgcaacaacaaatagttttgtacttggttaacagtcttagttaaaacatgagtttattttctaaaagtatccagaataagtaaaattatagaaataagaaaatgttacacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagtgcctgacttcccatatttgtttcatctttttaactgacagtatatctcacttcttctttgaatagaatgagtgagtgatctcagttttcacattttattcagaagctaatccctacttagcaaggcacacattctacagcaagtcatagaaagtttaatccttgtgcctccttagctctcgtatattcagggatctctataaaagttggtgtcttttttcatcatcataaattcatcataatcacagatatttttgggtctaagatattcatataccaaggatggttttgtaaagaattctgggatcattgaattaaggattgtggcttgaagtaactaaagaaaaatactaatttccttaaaaggaattataattatgatttacattttacatcattaatttcccaaattatatttaaccgtaaggaggtgcacatgagtttttagcaaacaggtatgaataagcagctatgtatatgtgtttggggcagaggggagcagattactttaacacacttcagaattaaaatcagttcgtttcatgactctgtgccttaacgtttgtgtgaactaaacttgctgattgaatgaaattcttgggaagccgaacagtaatagcagaaaatgtgaccaaatgagtatcatgtacttaaatcactgaattttatataagcacaagtattaattttaaaaacattatagtttaataaagctgcatttaaaaatatttgggagcaaagacaagcatgctaaatcttcattttgctatggctataagcatatatttttggcaacttatttgcaatattcttgccttaaagtttcctgcaaatttcccccttagtaattcccgaatagcaaaacattaatattccatgattagctctactgtgttgtctcactattaaaatggaattcgttttttcagatcttttctaatggttaataaaacaaatgtcagatcataataacactcaaatgtgtcttaattgtcttatgcatatttaagaagaaaaaactagtggcatacaggattgtcatgtagtatctttttttttttttgagacacagtcttgctctgttgcctatgctggagtgcaatggtgcgatctcggttcactgcaagctctgcctcccaggtttacaccattctcctgcctcagcctcccaagtagctgggactacaggtgcccgccaccatgcccggctaattttttatatttttagtagagaaggggttcactgtgttagccaggatggtcttgatctgacctcgtgatccgcctgcctcggcctcccaaagtgctgggattacaggcgtgagccaccccacctggccattttcttttttttttgaggtggagttttcgcccttgctgcccaggctggagtgcagtggtacgatctcagctcactgcaacctccacctcctgggttcaagcgattctcctgcctcagcctcccaaatagctgggattacaggtgcctgccaccaccactggttaatttttgtatttttagtagatacggggtttcaccatgtcagccaggctggtctcaaacttctgacctcagatatccacctgcctcagcctcctaaaatggtggcattacaggcgtgagccaccgctcctggcccatcatttccatatctatgaaatctattttggattttagagtggatttaaattttcaatatttcagtgacctcattgttaaagctgctttgccacttgtacaagtttgaaaaccattgttgaatcatatggagctttactctaattccaaatagttaaaggatgaatcaggttaaataatgctgttggataatacaggcaaaaacaggatttaaacccgcacattaaaagcatgactgaaggcccggcaggtggatcactttggcccaggagttcaaaactgacctgaacaatgtggcgaaatcctgtctctactaaaaatacaaaaaccagccaggcatgttggcgcatacttgtaatctcagctactcaggaggctgagacatgagaattgcttgaaccttttaggcggaggttgcagtgagccgagatcatgccattgcgcgacagagcaagtctctgtctcgcaaaaaaaaaaaaaaagtttaattctaacattgcccatggatttttttttttctgtacagcttgaagataagatagttaaagactctgttacaatttaaacatcataaaaatgtgaagagtaagtggtgaggcaagaaacaaaattgggggaaatggtggggatcgtgaatatataagtgaagttttatttttttaaggtgtaaaggagtgagaatagagtaattgctttttaaaaagaaagtataaatgggttaatttttttcttccaactttgactttaattcagtaagaaaggcctaggtttcatctcatattcttcataattgattttcaagaagttaatttgtcattcagcctaggaggctataaaacagcagttagttggcattattagactaaaacttgggtggggggaggagactgtttcctcattgctgcaacccatggtctatcctattcctaagccattagaaagaccttgtactttgtatagaaacattagagtgaggttttgatttttaacatagtactctcaaactttgatgtgcatatgaacaagtggattctgattcagtagatctgcattgggccccgtgagtctttttaaacacagtcccaggtgattcatgcagatgcctgtgaactgcgctggtagatgggcctaagaggcttcaggctgtgttttaggttttggtaagccaggcagattcaagtccttttataactgtcaattttgtgaattggggatgcagactggttttgaaggcttaaagttcaaaaattataagaaagttaagaattttgcttaagagccttttaaaaatatggacgatttattttttaagtaggcagactaagaatttcaagttataaagaatcttattgataaggcaaagtagacaaagtattttctcatgagtatttgtgggttatgtttttgttaatataaaagttgatttctaagtattagaatatatttagtctctaaataaatcttgccttctattatggatcatcgttattaataaacatggaaaatcaacactacccctaatattaatctggcagttaaatttagtagtgctataatgaataagtcagtctagcagatatgccctgtcattatactgcggacctctggtcacttaattttctgttatattatgtggttgaaaattcctgtttcatcgtaaagtgaaatttgaaagatggagttgaataatatgattctcgaaaagtgagtttttcttggaattctgttaaggtgttagattttcctcacatatttaaataatctgtaagaactaccctgaaagcactaaggaaaatgtagccgaaagttaagtaataggttttaaaaatttatcaaaatttattgatagtttgatctgtaaaacaaattgggtttcgtgctttctgatgtccagttaataagtatattatgtgccaggctttacatattgctctttgcaagtagccgttaaagtgtaagtcattgaagtttgaagatctataaatatttaatatagtagtctaaacagttgtgagaatttactcagttctgaaatagaatgttaaattttccgatgtggtcctaatcatttttttctttacatactaagccttcctttctccaaagaacagttaaaaccaaatgtgttatggtaagctgtaaataccgttggaataaaagataaccgttcatcttacctaaaaaattgaagacaatattttccattgttgatgtcacaagtaagaaaaaaactctaacttttgtactctacttgtagcagagggaatatttttggccacagtgtgccaatttataattgtagataaagctgaatttactgggcagcaagcttatatgctgatagaagttgatgcactgagaagtgatgagttgaagagaatggaaaaggcagattgagctggaattttaatgcatagtacatttagtagagagacaagctgtcctatatactcctgtatacttcagaaatagctgatagcctatagtctctgagagctattctgtacatagcacagtattataattgatgttcataaataccctgagagattatgttaaaatacattattaatactcccacaaaagcagtaagttaataagtatttccaacaaaaggcagctttgtttcttaaacggataaacaacatataactaggaagatcatcttcaaaataaagtgtcatggaactgaaaatagagtatagtctaacaattattttgatacactattgaatagctaacaagtgtctaaagaattttttatttttatagaataggaagtttctaaaagaaaacaattaagagcaaaattggttttgagtatagaaactgaaggatggcagtcttaactcctaagttttttacagagcacagattggtaaactagcatgccacctgttttttgtactatctgtgagctgagactggtttttacattttttaatggtgaaaaaagtcaaaagaaggacattttgtgacacatgaaaacatattaaattaaaatttcagtatccagaaataaagttttattggaacagctgtgcttattgtctttagctgctttcctggtacagtggctgagtttagtagtatagcagagtctgtatggcttccaacagtcaaaatactgcctggccttttaaagagtttgtcaatcccttttatggaggaaggttttgctcatgcatggcatgttagtcaatttagttatttgcttctagctggcagaatgtggtcttgattacttaatttctgttacccctgtgttttccagaatggcttctcctgattttacttacgtgttttactattgctcaaattacagatactaggaaacactactactttataagtacacttctttttcctacttaaactctcaaactacagttacgtatttgccatgatgttaagggaccttgatggtctgtgaattatcagttgctttctgcactacctcctgtagatagacctgactgatagcacttacaaaaagactgatagatgccaaatcagtcatttattaaccctctaatattgttgtcccgatcatttggtaaacgctaagagagcttagttttacattcacaaagtatttgtatttgataagtcttaaaaatgatttaagttgaagcctaacagaagtacttgttcattcctcagttacctgcaaataatggaaataatggtgcagtcagttttatttgattgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgaaaccatctaccccaacacctgtgtctgtggaaattgtctccacgaaaccggtccctgttgaaaaaaggttaggggaccactgctttatacagtgtttgaagtaggcacacttacagttactatttctggttctttatgactgttgagggggggcagaattctatgtttgattcacagtaaaacttttcatgaatcattgagggttaactgttatcacttgccaatggaaactggatattgaaacatttttttaagaaatgcacttttacctgaaataaaactataaaaactaaactctggtacttgtttttgttggctacattttggttttttgttttgttgttttcgtgagatctgaaatgagtatgaatagtttaattcaaataccacaaagtgtatgttatattcctccacaaacatgaacccttccttttctttttccccttttatggcctgctttttaaccacagaggttttctgatttatgcatagttttatgggttccactggtttctaaatccagaggtggtggtttttctgttgttgttgttgttaatgagttcagtttctcattgaacttgttagaagagaggtttcgtcaaataagggctgagtagatgcaggcaagcttggagaggcagtccacatggtgtgggcgagggcagaggtggcactgccaggctagtcaccagatgaagtaaatgcctcaccccaacatgaccttaacttcctctgcagaaccaagcatgttgatggcagccgaagaaaagctccatagttttaaggaaaacaacaacaacaacaattagggtaaacagtgatgttgaaagacactgtattagtttcctagggctgctgtaacagtaccacaaacctaataagttaaacaactgaaatgtattgtctcagttttgaatagtagaggtctgagatatggtatcagcagggtttgttccttctaaggactgtgtggaagttatctgtcccatacctctccccagctagcttggtggtgtgctggccatttttgacaggtagaggtatttccccaatctcccatcttcatatgactttctacctatgtgcctgtgtatttgtctaaatttcccttttataaggatagcaaggccattggattagggcctcatctgaattaacagcatctgcaaggatcctatttacaaggtcacattctgaggccttgggggttaggacttaacatgaatttgggggtgggagggtgggacacaatacagttcatacatttgagtgagatttgattgagatgtaacccatagacctaatttctcccttttatagtttcttgaagatggctctttgcagcctacgtggtagtggagatatatacaaaggacttccctagtatcgttggaccaacaagcacaagcagatggcaggaagattagaacattggatattgattgccagtttttaaggtgtgttaattttcttgtgattaatgttttaagagtcctttataagatacacactgaaaggtgactaatctataatgagattcagtataaggaagttacaaggtaatgagaggagtgcattggtttggtggagaggaaacagggttaaccatgagttgataatttttgaggctagttggtggatgtaggattattctctacttttatatatacagtcatccctcaatatccatggggtattggtttcaggaccacccctaccttatggatattaaaatccctagtgtaaaatgacctaatattagcatataacctatgcacattctcccatatactttaaatcagggttccccaacccacgggctgtggagtggtacaggtccatggcctgttaggaaacaggctgtacagcaggaggtcgagtggccggtgagcaagcattaccacctgagctctgcctcctgtcagctcactggccgcagtaaattcttcatgaactgcacatgcgagggatctaggtttgtgctccttatgagaacctaacacctgatctgaggtggaacagtttcgttccccactgtgtggaaaaattgtcttccacaaaactggtccctagtgccaaaaaggctggggacctgtgctttaaatcatctcttgattataatacctaatataatgtaaatgtatgtaaatatgttatactgtattgtttaaggactaatcacaagaagaaagtctagctgttcagtacagatgtgaccatctttttttttctgaatatttttgattcatggttggttgaatttgtggatgtggaactcaaggatcttggaaagccagctgcatgttgaacattttccaggctttaaagaaaaatctgtaagagacaaaggttctgttgttctttgcaatagcacctgcaaagtgtgccttggcaaaccgataaagtaaataggaaatttaaaactaaaccagccaggccaggtccagtggctcaggcctgtaatcccagcactttgggaggctgaggtggtcggatcacctgaagtcaggagttcaagaccagtctggccaatatggcaaaaccctgtctgtactgaaaatacaaacattagcccagagtggtggcgcacgcctgtagtcccagctactcaggaggctgagacacaagaatcacttgaacccaggagggagaggttgcagtgagtagagattgggccactgcactccagcctgggcaacagagggagactctgtctccaaacaaaaaaatggctcattgtaatggagatagcatatactttagtattctaaaagtttgggagttggaaatcacaataggattgttgcctacttgcatttttatccagtttaaggcaagatggaagacttgggagcaggagagtagcaccatttggcaccatttggatggttaagcataatctgccttttcttgggtctgcaaattccctaagggcatcaactgtctcttgttcttcacttgagcttcagcctctaacccagtgcctggcatagaggtgtacgttggtcattcgcaagtgagtgcgctctcttcacaagagcattttctccctgtgagtctcagacacattaagaagcttgaggcagcattactacggctgtaaagttacagggacttacctaccttctaggaagaacagtctgtaaacttaaacattaagccattatggttgcttcttctccctttgcctttgccacatgctgccatcctactggatacagatgggaaagatgcccttgaagttaggattggagtccacagatgttcttaaaactgtaatagaagcttgctgaatgcaagtatagatagaattttgagaatgtctactcttaggcataacagtacattttttaaatttagataattttttagtaattttatgtacaatttgcttcattgaatttttataggtagatattaaaaccattaaacataaataatgctcattccatccacagagttgcagaattagaggttttattagttgctggtttgtattgattataagtttataacttcagaactgaattagaaataataagcattagcaatcagcaaggaaaaggtgaacatctctgctatttttcctttaatgtgtttggcatattcaaaatccctgttttagaaaagaaataatgttaaaacatgtttataatggagaaagactctaggcacagaaataatattgcagaagcttttaaagtgtctgttctgcaacttattttaaaacccaaaggagaaaggatggtactaccataaatcacattgacacagaaaaaccataggcagcttgagaacttaggtaacagtggagagtctaaaccgaaacattgactgcaggatctgtaagtcctgcagacaagtgtgatgctttgaaatgcctaaatagcttcaacgtagttggctgggagcattccggtcctgccagtcctctgcacagtgccatacatccagccttcatcaattgcttgaacatttatgatggcatctccatccttgaaggacacctcatctgcatcagcagccatatagtcatacatggcacggaagattttctattcgtggggatggaaaaggggaaatattatatgttggatttgcaacagttaacacacatctatttgtaagatctctcatgactgactccacaaacttaagttgaacaaaagagaatgtgcaagcatcaacaaagtaaaaggaacccacaaaataggaaatacttgcaagtcatgtatctgataggcaattaatatccagaacatatgacgaactcctacaactcaatgccttcccccaccaaaagaggcaaaggatatgaatagacatttctccaaaaaagatagacaaatagccaaaaagcacacaaaaggatgctcaaaattagtcatctggaaaatgcaaattattaaaaccacaatgagataccccttcacacatgccagaatggtgatgataaaaaagacagacaataacagacattagaaaggatgtggagaaattgggtccttcataaaccactggtggaagtggaaaagagtgcagccaccttggaaaagaatttggcagttatcacatgttaaatacagcattaccctatggcccagcaaattccactcctaggtgtatacccaagaagaatgaagacataggtctgcacaataatttgtacatccatgtccgtagcagcattactcataatagccaaaaagtggaaacaacttaaatgcccaccaactgatgaatgcataagcaagatctggtatatccatacagatctattattgggtagtaacaagaatggggtagtaacaagaatgaagtactgacacatgatacaacatggatgaacttcaaaagtaaaggacgccatgcaccaaggtcagtatattgtatggttttatttatatgaaatgtcttaggtagccaaataatatagtgacaggaaatggatacctaggattggatggagcagaaaggggatggagaatgaatgccaatgggcaccagcatttgtttgtttgttttaattcaccagaagagttttgaatacagttttttttatggtgatgaaagtattctaaaattagattatggagatggttggaaaaaaagcttaaaatcattgtacactttatgaacttcatactaagttatgtatgcatgaaattgtgtgtgtgtgcgcatgtgcgtgtgtgtgtactgacagaaaagacagaatatgctgctaattttatttatggcctttttctacctttcgaagaggtcagtcttgtattttagagaagaatttgaaaacccgtagcactattgcatgtcatctttcactctgggaatttgggagcatacgagtagtaaaagtttctcaaagctatcctccacagtgttaaaattgtaataatttggaggtatataataagtgataatatcaaaagtttcttcctaggagcagccactggttagtagttttggatgtaacctatatggttttttcttgcattttgaaattcacatgcatatattcaaaatcacatgcatatattcaaattcacaaatagatttcctttcccctttgcataagtggaacattactataaataatactgtgatttgttctttccatttaatatagcttggaagtctttccatgtaaatatagctgtatcttaccctttttgactgctgcagagaatttcacattttaataatatcacgaattattcagccattttcatttttctggacatttagttgtcaccattttttcttacactataatgagcatcctaccgtttatctttgggcaaataatttctgaagaaaaagcttttgaaggtaaaagttttaggtcaaatggcatgtgtgtttaaacttattttatacatacacacatatatatatatgtataaaataattttacaaatagagatggggttttgccttgttgcataggctggtcttaaactcctggactcaagcagtcctcccacctcctaaagtgctgggattacaggtgtgagccactattcctgacctaattttttaagttttctgttaaaatgttcgaatatgatacaatatgatatttgattcaatttgatactttgtattatgtactttatcttatttttatattcttggttactagcacttttatttttatattcctggttactagtcatggtgaacacctttttctgttggccatttatatttattttgccataaattatctattcttagtcttccaagtcctattttgagggcgaggggaataatttatcagtgaattttagagttctttattctttttcaatattaatatttttgttatgtatgctgtaaatgttttctcccagtctgacatgtttgtatttatttgttatagaaacatttaaaattttatgatcaaattggccagacttttatacttctagattttggaatttgcctgggaaggctttcccctttatattttaaaataattgtggccgggctgagtggctgatgcctgtaatcccagcattttaggaggccaaagcaggcagagggcttgagcctaggggtttgagaccagcctgggcaacatagtgagcctctaccaaaaaaaaaaaaaaaaaaattagcctagaatggcatatacacctgtagtcctagctattctggtggctgaggctggaggattgcttgagtccatgaagtcgagactgcagcgagctgtgatcatgccaccacactgcagcctgggtgatagagtgagaccctgtctctaaaaataaaaaaaaagtattctgtattattctttgtacttctacaattttgtattttacatctaaatctttggtacagctacagtttatgctttgagatgggtatctaattttattattttactaaatagataactggttacctcagatcatataattaaataacttacccctttcttgctgatttataattcttttagggtctgtttctggacttcatctatttttgtatctattgccatgctaaatcgatattttgtatctattgccatgctaaatccatatttaattttaatagctttatagtatgttttgttcttttttagttgagtccttaagtattatcattttcaaattttacttgattatccttgcagctttttcaaattttagggttagcacagtttctttaaatgctattgggatttatattggaattgaatgcattggtttatttcagggaaaattagaactttacagtattcccttccttaaatataataggtctaacacttatttagaccttcttgtatgtcatttaataaagacagttgtcttcatacaaagattgttcatatcaatcctaaagtattaggcttttgaggatattatgaatgagatccagggttttaaactaagagttgtgaagtagtctggtgaactgtgaagatgatttggcttaccatttctatatatattaataggggagatctaagataaggcatgtatatatgtgggcacattgcatacatctatacattcttgatttttgagacagggtctccctctgtcatccaggctggagtacagtggtgcagttatggctcactgcaacctcaaatttccaggctcaagcaatcctcccacctcaacttcctcagtagctggggctatagatgcaccaccacacctggctaattttttggtttttagtagagatgaagtctcactatgttgcctaggctggtctcaaactcctgagctcaagcaatcctcctgcatcagcgtcccaaagtgctggcattataggcatgattcactatgcccagcaaatgtttaagatagtaggtgagaccaatgagccaaaactgatgctttgctctaggtttgggttttttttttaagttattgaataatgcttttcattaatttgagttagataatgaaagttttctgatatcattaatatgaaacatgtaataaaagagcattatataaaatagaaggtttggttaaaaaaaaccgtaatacctaatacttataatcatgtttgcacatatcaaaaattaagaataatttatttaagtgagttgttattcacttactccagcagtagatggatgagatgggatggaagataccgttgtctgttgggtagcaactgaagatgatcgttgttgtgggagctctgtggtttttgcatgtttgtaagctgaaaaaaagggggcaaattctttataagaagaaaaatggctaggtatcctttaatctgtgtttagcagctgagtgatgtctttttcccccaacttagaatgatttccaaaaagagaaatcaaagaaaatgaaacatctaacttcatgcagccctccacaattctagtcttttctcattaaaggaaaggatgaaaaatttttaaatttgtttttgtactcaaagcatctcttatagtaaccatcaatgagctggccgggtgggactgccaaaatcagcgccaggcacttgtacctgttgagactgcaaagacacccccgtcgctgtaagtcgaaaggtggtggtctggtgcttctgaatgctcagacttctcctcacccccactgatgcttagtgcactggcagatcgtgactgctcccggctccggcgctgagcttggactgggagagatgcagttgggggagatgtagcaaacatgaaatttctatggtagtaatgcctaacagtgattgaatctcagttattgttatctttgccaagcatggttttaagtactttcccatgggtcaaaccctcacagttattctgatgtaggtttgtctttcttatttttacagatgagagcttacgtacatgaccaaaggtcatggaacagttaagttgtacagccaggtttcaaatccaagagtctatttgtaacatctcccctccaccctgccaattttcctggctcaccaaaatgaataaatagtaatattcacattcagactccatctttaacttctccagaaagtcctccctaactgcaaatcaatttagagtctttctctgtgttcccaaaataccatgggcagacctttaaaattgcacatgtcagaatgcaaccatggatttacttctgtgtcttgatcagaaaactggagtataaatcctttgaggactgtctctacataatatcctttttttttttttttgagatggggtctctgttgctcaggctgaagggcagtggtacaatcacggctcactgcagcttcaactttctaggctcaagctatcctcccacttcagccccctgaacagctggtactacaggtgtacaacaccactcgcggctaatttttttttactgtttgtagaaaaggggtctcattctcttttccaggctagtattctgctttttaacatgaaaagaaggaatgaagttgtgcagcctgctttgtgtaatgaataaacttccttgatgcaatagagctcaggaagttcctacaggtcaaatcctttctcttccctttgcctatgtattttatgtattttcattatttctccaatagaattactactgttttttctttggaagaaaaattagaaatgataataatgggagacatgcactgaggcagtgaaacaaaattttttctaacttgaacttatctagaaagtaagttttgctcactagttaacaaggtatttttatgccaaatgggcagctcagaaaatggaaaactctggagggaaggaacttcagagcccaaatgaaagtcattgactctagcatactaaatggtgatgtttatgttgtaagcctttttcagctaacacaccattaatcatgtgtaagcttcgggactggatgttgtcttctgctggatcatagtcaaaaaccgaaccaggattagtacgccagacacgtaaacctgaaagggaaaccagtgatcagaacaagtgttcttggagttttccaataacttgaaaaccaaggcatgaattttaacaaccaccaaaggattgaatcacacttattccagcttaggttctgggtcatgtcttttcctcagaggagaacaaagataaggtagaaatcagctttgtaaactatgagataataggagctttcttgcacctctagaaaaacagattgaagtcctttatgttttgacttgatgtaggtaatgctacttttgttcttctaccccctcacttaaagttaatcccctcccccaacccaggctcagttacctgtaatagtctcctgatcttggtcattccgtttttgttccatttctaccactttcctctgaatacctcggtagttaatgtcactgaagtcctgcatgttcttctttactcgttcagtgataggatctgtcaccactggtgtgaagcaacccttgtgtttctcaaagtcttcatgatatttcacctgaaatgtcatgaatttgctttatgaaaatatgatggtgtgactatatccctttttacacattctgacaggcagccagccaatcctaaagaattcctgactcaccgttgagatgtgccgttgggtctccctcacccgtctcatctcgggggtatccaatacataggcagctttgccttgtatttgtttccggaaactatcagaataaagaacctgatgcaggagagaccgtgaatgagtggtgctgtcctaaatctgaaacctcaaagcctttccagcagatagagatggataggagctggtgagggacgcttgggtcaactgaaggggcccagtgagacacatgaccaattttggaacaggctaatctggggaccagaagggcccgccagtggaagagaaaggacttgttttgacttcgaaaatgaaactcattttcaaagaaggggcacggtataattttgaaaagagagtgacctcttgaaatttgctaggaattacagcatcaacatattcgatggtatttggctctaaatctgacattgtagggaatttgaaagaactgtcctttaaaacaagtgattattttccttaggttgtgtccagacttcataaaccaatatgctaatatagaaatcaaagtcctccagacactaaaaccccaaaatatatccaaagaaggcatccatttcagagtattacccatgtcataaagtatcttaaaactaaaggagagcagaagattgaggatgttaggaagtaaatttgttatagttggttacgtagaactacctcaaagtataggggaaggaaaacattggcaattaacttgttatgtttagtatgatggtttggaatgtaaaagcacagttaatgtctattttagtgtaaattttcagttgaataagtgcaaatttttatggtgttaaaacgttactttccaagatgttgcatttttctcttttaaaattttagtgtgtttttcagttgaatgagaaaggcgtgtttttatgatgttaaaatgttattttccaagttgttgcactatttctttttagtcctagaaaataccgagctaatgttttcttggttgcgcttagctctctccatctctggagtaacaggtgtcggagttgcttttctcatgttctctttgtacaatacctagggaagccaaaagagcatctaggcatcagacagcagaaaaccaggtctgaaaatcatcacttagctggtgttatggctcatgttatggctcagttatatcacactgaaggtaaagctattaaaatgttacggtaggaagcaaaagtttaagaaagaagtaaaatcactgtgacctcgtggggttggtttgttgtttttaagtggacaaggaagaatttttaaagatacacaaaagttttggaaaaactgtaagataaattagtggtacaaccatgtttgccagggctgttaagattttaaggatttatttttcctttctaaaataccgagctaaagttttcttgattgcgtttcactctttccatctcaggagtaaagggtgtgggggttgctttccccaggttctctttgtataacacctgtgagatacaaagtcatgcccgaaagtcactacgaggtaataatcactattaattatattgcaagttggggggaaatgttatgtttaatctattactattagtgagaacacctctcaagaagaaagcttaaaaatagttaatggctacagtaaatgtagtgtgatatttagagcagatgcaaatgtaactggcattttgtttgtttttaacctgggacagggttaggagcaggccaaactgcaagagttattttgcaaaattaaaagcacttttgtttctcaagacaataccgagctaatgttttcttgattgcgtttgactctctgcatctcaggagtgacaggggttgcggtggctttccccacattttctttgtacaaaacctatgggaatccaatgggtccaaaaagccaaaaagaaaaagagttaacagttaccaaaaaaggaaatggtacagataacttttgattatctttagggccccaaaccatttgggcaattaggttagatggaaagtagtatgtttcctaaggaagttaagtgtagttacagcaagacacaaccaggataggcacctgccctgaaacccttgaggactgcaagagagacctgtggtgttcctcaaaaggatgagaaaccaccatcattttaccgctagtctctcaatgtcaagcccctgagagatgatccaaacaggagttacaggcatgagcttcaatcacactgagaaggttgaggctgttcctaatacatcagctgtttgtttttttttgttttgttttgttttgtttttgagacagaggagtcttgctctgtcacccaggctggagtgcaatggcacgatccctgctcactgcaacctccgcctcccgggttcaagtgattcttctgcctcagcctcctgagtagctgggattacaggcgtgcaccaccatgcccggctaatttttgtattttttagtagagacggggtttcactatgttggtcttgctggtcttgaactgctgaccttgtgatccgcccaccttggcctcccaaagtgctgggattacaggcgtgagccaccacacctggcccacagcagctgtttttttactggactgttttgcagcacttaaactctcatagacatatcagtaaaactgtaggccctcagacaaagcaaagggtttcccctaccctctttttctttgctatcctctatgctctgcctcttgctttagtttcatacaacattcagcttatcattaaggaataaggtttttggctcttatatcactatcatggcgaatcagtggaaaatgagaaacatagtaacacatcatgataaatcctcaacctcggtatctcccctcagtgtcattcttggaaacgtgggagatttaggaaatgacattgaagaggaagaattctgttgaaatagtgattctcaacgtggggtccttggacagcaaggtcagtaatgagaacttgttaaaaatgcaaattctctggccccctctataacagacctacagaatgagaaactagagcaggacccagcaatctggcttcacaaaccctgcacgttattctgatgcgtgctaatgttttagaagcactgtactcaagtactggagaaacctacagatagtggaaatgtggacaccacaaggttgtttgctactgaaagctgaagtccccctgcaaacctcaatccctaggtaatttacaaccatatataatgtcacagagcacaagcttacgggaaatggtttactaaagtttgcagttaaagactacagtaaaactaaagaacaacaacaacaacaaacaaaaaacgaaaactggtaaaacaaaaagccattctggtgacactttcatttttaagtaagtaaattgataatcaataattgccaaaactactattggatcataatttatatcattattcttgaaggaggggatcagggattatttttcccaaggtctctttgtccaaatctgacagggtaaattagaacctgaagtcattgacacaaaaacacaacaaaatcatatttaagaaagagccgcattggacctactccaccaccccacacgtacccgtcctaaatttcaagcatatctaaaacaaagagaccttgggggtagtggatagagagtaagtttggagagagagaagcaaaaggatgttttataggaaaatctgttacttcttgatattagaactttatggattaaagcaaccttgttattatggggttaggctagaagtagcccaaaggaaaaaagggtaaatttgctaaagaaatttcacaaaatttaagttgtctttaaaaagtaggattaatatgtattattttaaatcataaaagtagtttttaaaatcagtaagtagtttttttcttttctcgccaagtaccgagctaatattttcttgattgtgtttgactcgctccatctcgggagtgacagctaaaggagttcccttgcccatgttttctttgtataacacctgtgcgatgagaaagcatccagaaaaacaaccatgagtaacatttcatttgttgagaggttttaagggtaaggtcaacttccttgttaagaaaacacagtcgtccaaggagccagaagttatatgctgacaaaatgccaccagctactttagtggaagctgttgttgggatggggaatctgcaccctctagagaagcagggacctcagctgctggggaaaggctgtcagagttatccatgttattttttttcatttttgtgagtacggtgcctcctaaacaatcacatgaggatttgagactgttagaactcagtgttgttatccacacaaacggaaaaactcatttttaaaaaatgattgaaaatatcagatgaaataaaaaatcaaaattaactgtattatggaaatggtgttaggctagaagtagcccaaaggaaaaaaggataaatttgctaaagaaagaagttcacaaaatttgtctttagaaaataggattaatatgtattattttaaatcatgaaatagtttttaaaatcagtaagtagtttttttcttttcttgcccaagtaccgagctaatattttcttgattgtgtttgactctctccatctcaggagtgacaggtagaggggttcccttgcccatgttttctttgtataacacctgtgcgataagaaagcaaccagaaaaacaaccatgagtaacatttcatttgttgaaaggttttaagggtaaggtcagcttccttgttaagacaaaacacagttgtccaaggagccagaagttatatgctgacaaaatgccaccgactactttactttagtggaagttgttgggatggggaatctgcaccctctagagaagcagggacctcagctgctggggaaaggctgtcagagttatccatgttatttttttttttccttttttgtgagtaccatgcctcctaaacaattatatgaggatttgagacagttagaactcagtggtgttatccacacaaactgaaaaactcattattttaaaaaaaagattgaaaataccagatgaaataaaaaattgaaattaactgtattatagaaatgggaatggtgttaggctagaagtagcccaaaggaaaaaaggataaatttgctaaagaaattcacaaaatttaagttgtctttaaaaagtaggattaatacgtattattttaaatcatgaaagttttcaaaatcattaaataagtagtttttttcttttcttgccaaagtaccgagctaatattttcttgattgtgtttgactctttccatctcgggagtgacaggtaaaggggttcccttgcccatgttttctttgtataacacctgtgcgataagaaagcatccagaaaaacaaccatgagtaacatttcatttcttgggactttttaaggatgaggaaaaaacacagtcatccaaggagccagaagttatatgctgacaaaatgccaccgactactttagtggaagctgttgttgggatagggaatctgcaccctctagagaagcagggacttcagctgctgaggaagggctgtcagagttatccatgttattttttttcatttttgtgagtacggtgcctcctaaacaatcacatgaggatttgagactgttagaactcggtgttgttatccacacaaatggaaacattcattatttttaaaacatgtttgtttgtaaatatcagatgaagtaaaaaattgacattaactgtattatagaaatgggaaagtatatccttttgtaatataagatgtattagaagcaaagaagggaaatgggcttcaaacaaaaataaataaatgtaaagatcagtttaattctgaagttaagtggcattttttcccctttctttccaaaataccgagctaaggttttcttgattgtgtttgactctctgcatctcaggagtgatggggattggaattcctgtccccaggttttctttgtatagcacctgtatgatgagaaagcatccagaacaaaaaaagcaatcaatcagtcattttccccctgctttggagcagttgggagtgggaagggaggaagagagtaagttagaggaagagaaataccagaagcttttagactcaacctgtttgtttgagcctaaagacatcttcaaaagcaaaggaatgcaggaaagagcagcaaaaactaagaaataggaaaagaaaggttgttattttcattgtttgaactaatctctgcagcactgagcaaccgtgaaagagcaattagtcttttcccaccttgttacaaggagggaaaaaagtagaaacagacaagaaaccaaggaagttacttttgatttgaaaatgctgttaatcacatagggatatttgggttttacaaacattgtgtatatggagacacatacacacaactcttcttttgttcactttcaaaagaagtcagagtatttaatttttagtttgggtgaacacattgagaacaacgatgtttaaggcaaatggagagcaatgataaggtgctaaaaaaaagaaacttcaaaatatctgtacaaataacagtagagatagaaaaggttagaataagaaacgaggataatagtcggatctttgcaaaatacatttgtttaagctttaggttcagatcaaatttgccaaagcagtataaatgtggatgcttagacactgagaatgttacatttgtaaaagcaggaatataatactgaacactttttttattaagttaaatgattatattaatgttttaccaaaatggggaaaactgattcataggaaatggcagcattaagttgggaaaaagacaggtcaaattttttattgggatgagttgattagatttttaaaatctagccattaatctttttaaacatttttttaaataattaaagggattttttatttttaaataccgaactaaagttttcttgattgtgtttgactctctccatctctggagtgatggggattggaatcccttttccaacgttttctttatacaacacctgtatgacacaagaaagcatccagaaaaaacaagagcagtcaaaacagccctttcatctaccttgtggggaacctggtataaaactacagacgtcagacagaaaagacagattcaacaagtcaacctctctgttcaggcacagatctgggtgagaacatgttttgtatttccttagtgaaatatcagtgtatttgatattcatcatctttttattgtaacttgaatatatttatttcctgtgccaggaattaaggaaaaaaatacaaataatttcctaagaccactaaaatactcagtgtacaatagaaaaattgcttaagttagattagcaagtatttattttctctacaaaaagcgtttgtcttacggtctaacaaatatttaacaggccaaatctatgcaatatggcaatttggtccttgtcattaagttcaagttgttgtagagatggtcaagtatagaggttcaatatgtggcattgtctattttccacagtatctaataggcttatgcaccactgggcaattttgcctaaatgcaatctgtgtaaaaattaacacaaatggttactttaaaaaaagtccaggatcattaaggtttcaaatagatacaaataataatatacttactgtagtatacaagaaaataattagaaaataattttgaaaatcgttgcaagcctttcaataaaaggaataataattacaacccacagggaaaacaatgagtataacattccaaaagacatattaacattgaaaatttaacaaaattgaaggattgttagtgaatagtaattaaaaaacaaaacagaacaaaaagacagtgggaccaaagaaagttactgatctaattatgtcaaagaatcaaacttttagaatatatttaaactgacaattaaaaatattttggattaattcccactccccagaaaaaaatccatctaaattttcctaatgacatttgattctccatcacaggtataagtgaacctaaggtcttgatatagaagcttcagagttgtatataatacacaaataatttgtgtgttagagtttttcagcaacaatattaataaaagataacattaaatataagctcatgatctgatttgtatattaaaaaaaaatcagaaggcctggatttctattcatgaaatggcttgttttgaataagtatcaaaataagatttctttcttccttttttttttttttttttttgaaacagggtctcactcctgttgcctaggctggagtacagtggcacaatcacggctcactgcagccttgacttcctagggttcagatgaacctcccacctcagcctcccaagtagctgagactacaggcatgtgccaccacgcttggctaattttttctatttttagcagagatggaatttcaccatgttggctaggctggtctcgacctcctgggctcaagtgatctgcctgcctcgacctcccaaagtgctgaggtgacaggtgtgagccaccacgcctggccccaaataagatttcttttggtttcaatatggagcaattttctttcttggtgctattgtttatctgaatagggtctatgttaagatgatccctgttcctaaggaagagccaccatttctatatgtggcttcaagtccagtatcttttcttgcatctctaacccagaaacatcagataaaaagagttccaagtaaataagagctttagtgtttggtttttcttttctggaaatcaattaacttcaacagtcccaacaacataaagatgaaaagagaaggaaagaaaaagttttaagggactattatagaaagtataaaatgtttgttagaatcaaatggtgagtaggagatctggaaaacagaaggattcagttgatgtgattaaaaaaagattttgttaaattgattattataaagggatgaacagtgagatgttctgttttgtagaaattattattttttaatatggagttaaagagctttctcccaaataccgagctaaagttttcttgattgagtttgactcgctccatctcaggagtgacaggtaggggagtccccttgctcaagttctctttgtacaatatctgtgtgcacaaaaccaacaaacaaatcaacctggacccatcattttttaggtagacttaacctaaaaaaacagcctaaaagaagtatttttattgttgtttttatgatgaagtacctcagtaacttttaaaaatagagttaactatagatcccctttggacatttagtcacacacaggatgtctgtctctaaaagacatcagtaaaacacagctgccaggctgccggcaggagtggcttgacttatgtaggccttctctcaaagaccagagtatcaaatagcattcaaactaattgaaattaatatccatgagttgttggtaacattaaattagggaaccaaagaaagaggagagagagagacaggtaggtttgggggaacaaaataaagaataaatgttgaaagctaaataatactagctttcaatgatactgaaagttttccaaaggaaaaattaatttatatcttacatagcatacaaaaaatagccaagacaagtaaattatatttactgtgaattgctgtgttgtctttgaatgaaaatgtttaagaatgacattcttttaagaaaagctgcaaaccagtgacctctaatgagattggagactagtattgtaagtgaagtaactcaggaatggaaaaccaaacattgtatgttctcactgatatgtgggaactaagctatgaggatgcaaaggcataagaatgatacagtgaactttggggacttgcaggaaagagtggaagtgaggcgagggaataaaacactacaaatatggtgcagtgtatactgcttgggtgatgggtgcaccaaaatctcacaagtcaccactaaagaacttagtaaccaaataccacctgtacctcccaaacttatggaaaaataaataaacatctaaacataaaaaaaaaaaaacttaaaagctgcaaacataaagaatacattaaacagccacaataaatacaaataaaattctaattaacattgtccttttgaaagggtgttagattttacttttgactgtgttacaccagttagaaacacctactgttattaaaggaggaatggaggaagaaaacagagtattacaggtttttaaagaaagtgataaatatctatgttttagagaaaacacagttaaaatttcacaccagaactaaatactaaattagatttgggttgaaaactgaggtaatatttggtatcattattttcattatatgaatttagtaattttacatttgtaaggtgttattattttaaataaaattaagggatttttttttttttggccccctaagaaataccgagctaaagttctcttgattgcgtttgactctctccatctctggagtgataggtgttgggattcctttccccaaattttctttgtacaaaacctgtgagatacaagaaagtacccagaggacatttaaaacaggcacagagagtaaggaaggaaggaaatgggggaaggggttatatgtgaggaggcagttttttagtaagtaatatttagtaaggataatgtttttacttttttcacagttttaatgatgaactctacaatgctaattctggaaatgaaaaagtacaatggaaagcattaagttatataacgctgaggaatcttgttaattctacttatagtatttcaaatctagtcaagtcactgaaaatgttcaagtataatcggaaatgtgagtcattttgtattaacataattttggtcaggtaataatacacaacacacacagacacacacagaattgctgttaagatgttactttctttaaaaaagatgggttattgtggtaaattttttatgggaaatagtttcttatatgatatatttgtaaataccgagctaaagttctcttgattgcgtttgactctctcaatctctggagtcacagtggttggaatgcctgttcccaagttttctttgtacataacctgtagaaaataattagaatacccagaaaggtaaaatgaccgtaaatcctttagatagcagccacatgtgggctatttgggggaaactcataaaaacaatctagctctcaaatataacattcaaggaacaggggggaaaattccatgaatatttatgttgtcttttccaaaatagtaaaaatttttactactttgaaaactgggcactaaattatgcattttctgtaaccacttagtgcatgcctaaaatgcattaataaataaatttaccaatgagaaaaatctaaccattttgttgcatctagctttggtgcctcaaatatagtaggcctgcagtagacttgtacttaatgaatagattgcttggtttaaaattttccaatcataggatactctattccttcaggcttattgagaattttctttttgttttgtatgttctaatgaatgttcctcgctggctcctaatctgtaggagcctagtccctggatgtgagatggcttaatcagtttatttttcaggaagagcatctttacctgaaatttttactgctaattgctggatcaagtaaactagtgttttctgaattgggagaagtccatattttttagtagtagtatctaaggactatgcattttaatgaaaacattaaggaacctccactctctgagcctccttaactcttaacattaagttttcagcctaaaggactgaatgagttcttttaaatggatggattccctggtgtattagtgcatggcgtggggagcaacgtacccagattttaattcttaaaatcagtgacaagctaggcgtgatagctttgttttgcaaggaagcttctaggaacctttgaacatctaccttcttggtaacaaagttgcatttctttactcttcacccaacaaagcagcagaattgatctcggacaacagcacaaagcaaaattaaagaaaaccaagaagttgtaatgcaaagtgacaaaggagcctaggctagctttctcaactcttattagaggacacaaaactctaaatgaaatttgtaccacaaggaaatctgtaccacagagtataagcagagagtgagaagggaatgagatctaaataatatgaacaacctgcaagagaaatatcaagtatcctaaagaaaatcaaatgagagttcagtcctccattgaccaggggaatcccaagaccaaggtcctccccttttattggccataaactatttcccaaacttcacatagtcttttgctagtagccaacacctgcctagaatctgcgtatggatgggaaaaggggtgggtgcagagccagggcttgcttgacaaaaggtcaggagaaatgtgctaacctgatatttcaggtgtgggggacacgtgccctgcaataaactgcacaggtgcctgaaattcccatgacagaacaggcttaatgtataatataccattgtaggtagatcgcagcctgtaccactgcatttactagatggagagagcaaagaatacaggagaagaaaccttgaaagggaggggagaagagacttcacatgtctacccagggtctttttggacactgggaatcctatcattcatatgatgtgtcatacatacacacacacatgttttatatatatacacaaaaccaaagtatgttatactacttatatgtttatatgtatatgcttttagttaaattacttgagatcatcccaataaccttattactaccatcaaaacattttactttggaaacgaatggcatgataattaattaagaagccaagtccatgagcttcaagtcagtgacaggtaggaaaagaaagccaaatcccttctactccttgattatgagaaaagtggtttcttatctacttttgcaacctgtagtgaccccatcaagactaagggagaattcacaacatccccaaggcatggaagctcttgataggaagcagaaagatgagagagcaccagggtagcaattgagagatggccagtcacacaaatggaagctgagagtatggccactaccgagctaatgtgcttctgcgtctccttcacacgtttcacttcaggcaggtcagggattggagttccttgtcctattgcttccttatacttcacctgcagatttaaaaatgggaaaagaaaggtattattacatgctggactgttattcttcccaacatgtacatgttttttgtagcccccaaattaaaaaaattaacagtgtaaataacgcaggctttatacttagtgtgaatgggacctcattctgatactgggtaagaggagaacaattccaaggacagggacgctttgtctctctctcgtctctttggggcagggatgggggcccctatttagactgcagccctttcctgtatactccaatgtctttatgcccagcaggtcgtttgactaggataaacagattgacatacatatatccaggaaggttggttctttgactgtaccggattctaccttctcacaagcctctctgtttttcagatctaatctctccctcatgaaaaccgccaaggcactgcactgaatatgagatgactctagccactgtgtggtggtggtacacaggcacctattttagcaatataagctgtttctggtgacagaggctttgagtgcaactcataggtcattgtaaattatcaaagggaggcagaaaatattgcaagtgcattcactgtgtctttaccgagctaatgtggtcctgtgtttgtttcactctcatcatctcaggtgtctttccgatagccgttcctggtgagacatcctctttatataaaacctgggcattcagaatcaggacagtgttaacacagaagaaaagaaaacccagcagttcctggagaaagactaggacacatggcttttgtgaaaacaagacactagacgatgttcccaggcaagtgccagagcatcgcacctgacatttccatgtcagtatcagtgactcagaccagttatacaacatggatctttccagatcttaagatttcttctaagattgtggtataccatactaacacaggatgagaagagccaggaaatgttgattaacaacaaaaccctccccatatgtaacacaaaatccattaaagaaatgcaaactcagtcagttatttgggggagggataacaaaagaaatcacaatgtcaaaaagaaatccatcttcttggagcaagacaacacatgttactgccctgggattaaaaaatttaaaaataaaagttacgttgttagcagatttaaagttatttcaaatggtctctggagatgattttggagcaaagtattggggattttagcaaatcactgctagtattactgaggaggttagatgttaattgtgtgtatcaatataaggctagtatatttttaaagaggagagtgaaatgactaggttagcattaaatgcaaaataaatagtaaatataccgagctgaaattcttctgattttcttttacacgcagtatttctggcgtgtcttgaacaactgtaatttttcctttactgtttttaaggtcacactggtattggagctatgaagaaagagtaaacatcttgttaagatttcaacattgctttgttttctttatttgtcctatattatgtgaagaaaattaaaatcctgtatctttaaaaaaaagtctatgcacaataattatggtctggtagcccaagggaaattatttgataagaattttgtggagaaactaattttaaaaaacatataaagctaggggtttgtttttgtttaagtatcccttgcttagtagatttaactttgaaaaagatagatgtctccactaatggaaagcagtgatagttcacattcagtaaaggaagccactgacagggtttaggatacactaccccaaaataatggcaccttggcatttgaaaaaacagcagaagcaggagggtttttctggccttctctgttttttcctgaagcagataataattatctgaccttcatttaaagcaggcaataagcctctccttccagaagggtcctccctagacccagaggaaaggagccaaagacacagagatactaggagaatctgaacaaacagccatcgctaaatcccctgtttattaccattggatcatacccctctttgtccaatcacacttccgcatctctatccataaaaatacacatatttccctgtttctttgggtagtcatttctgaagcttttattgaataaattgtgtgtctctcttgttaatctgtcttttgttacaggggttttcgccatgaaccttgccatgggtgaggaaaagatactatattttctccccaataccaccaacgaagtaacagatgagtctttcatgctgtgatttgggattaagatacaaggtgagcccagagatgaattgggcacacatttcctggggcaggatgggagttgtggagggctgcacaacagccccactgcaagcctgggatatccagaggcatcttcctcagcacccctaggtgcctgtgggctgtgccttacatttaataaaaacttacaaggctgaagttcttttggttctcccggactctctgtatctctggggtgtccaaaacagtctcataatacgacatggacttctcagcatcttccttgtactttttctgggaatagattccaagaaataaggagggtaaacaccacagggatataggccaatgggacctaaaataggctattttagcccttccaggctcagcagagggaaagtcctttgtattttcttaactgtccaaggatgttagggcatcgcaaggaagaaccctctcagtcaaagaaagagcaccatactttttctttccaggaaagctaagcccagacattcagtaggacctattgtcatggcaaagctggcagagggggaaccttgctagctggtccacaggaggaaggtcacagccagcaaggcccagagagggagatggggatgcctccagtggcagtagtcctcgctgggctggatgaagctatgtagccagactgttcaacaggcaggcggagagaagctggagggttaagagtcaaagacatgacctctagaaagccttagctggtgacaagatgttcactgagccatgagcaggtgcggtcagggctcccagctataggactgagccggcagtcagacaggcaggcccagaggcatttccagaatatggctcttgatgctgcagaaagcagcctgacaggactggcagctctaccaaacagacacacctggagcactactaaggccagctgactggccaaggactgctctgaaccagacatcactattccttgggctcccctgtcctgccccagcctttggctggagagacgtgtccatatagaggctgctcttccagacaccagtgggcagtcaatctcaccaccaaactgatgattgtttttattctctgcagcagaacactttagagccttatttttctttcatcatcgcttgtcactgtcctttcacttttctctctagcttaacttagctccagtttttcccactcttcagggaagttttagtttgtagggctgagggctgaggaatgagactagccactgttataatggggataaaactattctgtctgtctctatgtactttgttaatataggaattacatttataagtattgaaatttgtaatcttgccagagacaacaaacaagcagtttcagccaatgagagatgtaggcctagattttgttcatctaaatggaagcgaattaaagccagatttttcggaagaaacggtagttcatcatgaacaaatgttttgttcatgaaaaagtcacctggatgactccttagctatgtagatgtaaggaaaacagttctcattgtcctgggaaaagaatagaaacaatcgtccttttattttatttttattgtttttcttttattttttccaagattaagcaaaagctacctcaactggtttgcagagctggtgctaatcccttagagggataatcacatttgcacacagaacttggatgtattctgggagaaagggacctgaactccctggtgttcccagaccaaattgagggttggactgctatttctcgtggcccaataatgaaatgcagatgaactggggaggaagagaggttttttttttgtttgtttggttttttgttttttgaggcggagtttcgcagtgtctccaggctagagtccagtgacgtgatcttggctcactgcaacctctgactccctggttcaagcaattctcctgcctcaggcttccgagtagctgggattacaggtgtgcaccaccacaaccagctaatgatggggtttcaccatgttggtcaggatggtctcaatctcctgacctcatgatccacccacctcggtctcccaaagtcctgggattacaggcgcgagccactgcgcccgaccaagagtttttatttctgtaactggttaccgggagaaggcctggaaattatcaccaggccaactcaaaattacaaagtttttcagagcttaccttttaagctatatgtctttgtgtaagtgttcattcatctaaagacataagtgattaacttcttttaatttataactaaggtctgagttctgaagaccttcctctggagcctcagtaaatttacttaatttaaatgggttcaggtgctggggtgattactcgtatgttgtctcctgctaaatcagggaggtttgaggagtttcttcagacccccaataaacttgtttgtggaggcctggggagttttttttagacccacagtaaaacttgtttaattctacatgggtcctgttaagaattccttcattattttgttatgctttaaggcccaggaaaggcctagccgaaacttttggtgggcttttgttacatcccagcctttgtacagggacactggcttttaatatctaacttaaccattcatttagtactcaaacagttgttagtgagacctggcctgccatactggcattaagtattcagtacagtagtccccacttatctgaggtttcactttccacggtttcagttaactgtagtcaacctcggtcaaaaataagagtacattacaataagatattctgagggagagagagagaccacattcatgtaactatataacttttattacagtatattgttataattgttctattttattagttattgttgttaatctcttactgtgctaatttacaaattaagctttgtcataggtgtatatgtataggaaaaaccagtatatatagggttaggtattgtctgtaatttcaggcatccactagaggtcttggaacatatccccctcggataagaggagactactgtatagtatcctaaatttgtgagtcagcttacattgcttgtattaacccccaagtatgaggtttaagagttataaatacagattctccattggaaatcgagaagcaagtttgtggaaacacaagcaccatctcaccagtatttaccattcaactgtaaatactgatctgaattggggaggaactaacttgcctggctatattttaggccttgaggaaccagccaaagagagccccaggagagcagagcaagtgacgtgatcccacactgggataggtccacatgctgaagctttcgttaaagatcagcagtgtcaaaagcagaaggtaaaaggctggtgaggctctcacagcccaaagaatatcagcctccctggctccctcagtgaacacaacatggtaatttggagcccatatcattttggtagtttttaaaaagctaattattcttctgcatccctacccttcaaagaaaagaaacatttccaccatttgaatatacctgcttcctaatcaaaccactctctagtgataactatatttttcatgtgtaattttacaatatacaactatatgtttccagtaaagggttgaaatccttgattccccaacctgattggtcattaagagatcatctgtgaaaattaaaaacaaacaaaaatagatttccagagcctaccacagatttactagcatcaaaattccagagttggaccagcgaatctacatccccaggtgcctataaagcacagctagggcacgttaactatggctttggaactcattgatcagaagacaagcacaaattctaatctggcaccactcaaacaaattgcagactcctgaccatcactgacaatcgttcatacaagtgaaggcctatcccagggtgtgaaggatggcctacttttcttcatctctctatttgtaggaagatgatggagagttattcatcatgaggggagtcaggggttagactgtgtggtctcaatctcagtcttgtttgagattggtaatccaaatgtgggctactttgtttcttccagatctgcgcacacatttttaaagccacatcataagagattttacatgttaaaatattgattcattaattacaagttgtaccatgttcttcagtaccttaaaagagttcttcactaccttaaaattcctgcatcataggttaccctctcactctttttttttttttttttttttttttttttgagacagagtcttgctgtgctgcccaggctggagtgcagtggcgtgatctcggctcactgcaagctctgcctcccgggttcacgccattctcctgcctcagcctcccaagtagctgggactacaggtgcctgccaccacgcccggctaatttttgtgtattttttttagtagagatagagtttcaccgtgttagccaggatggtctggatctcctgaccttgtgatccacccacctcggcctcccaaagtgctgggaatacaggcatgagccaccatgccgggcttctctcttttttttttaagagtctcaccctgtcacccaggggactgcagtggtgcagtcacagctgactgcagcctcaaccgcctgggctcaattgatcttcccacctcagccttcctagaagctgggactggcgtgcaccaccacacctggccaatttttgtagggacagggttttgccatattgtccaggctgatctcaaactcgtggacttaaatgatccactttccttggcctcccaaagtgctgggaatacagacgtgagccactgcacctggtgaatctcttttttattgggaaaaactgatctgaagaatctcttaaggtatttattaatggaaggacttccattctttcatgattggggtttatgagtgatggcatgacgaatgtccttacctggcttgaaagattcttgacttgttgggcatgaatgatctctggagtatcaaccacagaagtgaaattggctttctccatttctgctgattgcttatacttaatctgtaaaacaacaccgaatagttgggtaaatgtttgcaatgtgcacaacagttgttggcttgatttgattaagaggtgagccatatttcttttccaagagggactcattcatttgacattcaacagatatttcttcctattttgttcatagttttataccaaagagtgagattcagtaagaaaggtcaagtcctagctgttgagagaagatttagttggatgcaggatgggatatgggtaaggagggatcatcaacagatagtaaggcatggattgtttacatacgagctgggaggatgacaaataagcaaaagacccataccaatgagcattagacaagctaagatgcctaaaaactgttctaaacttagggcttgaaaggagaggaagaactcccaagatattctaagcaaggaattcctggcatcaaatgagtggactgactcagaaataaggccaagatgtcgagtttgccccagctccaaacagctacttaattcctcagtttctgccctttgctctgaatgtccccagagcctatagacttagaaaggtagacagcaatgagcctggcaaagggtcctccatcctttcattgggatggcttcctccaggcagatgttcaagaatgccattgtatgcatgtgactgtcaccaataaatcagatgacagagggacactttatgtccttaaagttacaactactttcctgaaagattgacatcgaatagtagcactgacctgactggcaatatcagtagcattcctggccctcataaaatccggagtttcattggccatggcattcaggcctcttcctttgacttccagttccaggtctcgcttatattctttctatagtagcattaaaagaaaaaaaaaaggtacctaaatgctactactaggtaataaacatacagggtgaatgtaaatccacataacacgccaccccagttgtcacagatagtgtcgcttgctactcttcaccttcgctcttccgtgtggtaggatgaagtggtgtcttcagaagccctctggaggaaactattctatgcaagtcagtatgggtcaacagaggtctccttttgaatacttttagcattctctgcttagaagattagagtataaagtaaattgtacatctagtttggtacataactaagattacacttaggtgcacaccactccagtgtagtgttttcgtgtagatgagcacaccaaatatatcaagttaaatcaaataatattagataatagattatgataaccactacagaaacacactgttacaatatccattcatcagaaattgaggtatattttatgtaatggttaacaattatgttgatatggaatctgaaaatgaaaagctctgtttttctctgttctctgtttttgttttgctttttctggtgtaatttggctaacaaagaaatgatgctgtatgaattacgtgcaggcagtcagctgtgggcctacctcattgaggatttgagtggcattctttgctcttagcatgtcaggtgtatcttccatttcagtgaggcccttcccacggatgctttcctctagatctttcctgtactctttctatatcatgaaagaaaagcaacaacattgacaagaaagcccagattgattctctcaggcaaagaagaaaataaaaaacaattccaatttttaaagggttcacagtttagtaagtaaaaatatgaatacaggcagggtataagcatgatcagttaacattaaatatcaaatgaaagcttgaagttaatagaatgctaaggtaatattcaaataaaaaattagaagaattaacatgggtaatagattaggtggtagtaccaagcacatgagaacccaatttgaaacccacagttaggtggtgatgtaaatggtaggaggaacacattaatgagtgtcactagtgcaattatttggattaagagggaaagaaaagaccaagtgggcactacctcgcttgctattttagttgcatatttgacatgtaacaaagctggcgtgacctccaggccagtcaggtttctgcctttaatggactcttcataatctttcctatattctttctaatgtaagtaggaaggaaagacaagttaaaaaaaaatctttattacaatatatctctccatctcaggaagaaaaaaaaaacagcattttctatgtatgggctcttaatcatagttctgctaatggtcacacatttgaaacatgtatgattgtacttgaaatactttgtctggagcaaatggccacaaggaaattcaggctgagacactttgatgggcccctcactcatcagtctaatgttgtgactggggcaggcccttcacagagtggaaggatggatgcaccatcaggactctgaatcctctgttgtctcttctgaactttcccacacctttcttaaggtgacaaaagactttatttcagaattacaagtcagtgaggcaaggggaaaaaaatcgcagtggaaggagagcctaaggctaccaaatgctaacttgctttttttcctaatcatgacctgtttttttaatatggggtcttgctatgatgcccaggctggtctcaaactcctgagctgaagtgagcctcctgcctcagcctgctgagtagctgggactacaggtgtatgccaccacactgagttttgacctgttttttaaaaatcactgaatagcttaggtgggcagtgaggcacagaggaattgtatggttttgtccactctgcctccctgccccatctcctctccagtctccagacttagctgactcacagaggggcttggaatagatgttggaactctacttttgtaattttgttattttaatagaattttaaatttacaggaaagtcacaagaacagtataagaaactcctatagatcctttactcagattgaccaattgtttgaagccattttaaagttttgatgacctgacattctatcaccagaaagctccacaaactgctgcttttatttaaaacaatttttctttatagttggaggaagagaggcaaatggaaattccaaataagcccatttcccactgaagacagactaagatttaaaataagattccattctctactcttggttaaaaatgaccaaaagaaaatttagtgcttctgcttacaattctaaaataacgaatatggcatcttcacttttgattatctggggtcttgataaacatcttgatcacaaatacccttttgtttggcttggggcattctactaagagtagagcatttcaaagccaaaggggtgtctgtgtggagggaacttttcattcataaaggaaaatccaaattacattcagtataatttgtgttgggaatagttttccatgttctaattttacagaaatggctgttgaaataagacatatggtaaatatttactacctagagcatttttaaaaaataactgaaccataggatttctgagatggagaagattttagtgatcacatgataaaaagtttcatcagctaccacttttggatgacaggaaactggccatgtcatgggcagagcttgtgttcagtagtgtgatggatcattgttgtgtggtgtggtttttttgacttaccccactctgcatctgctgagactctttggcagtgatgtacgttggtgtttcaaagtccagcatgggttttcctcgttccttttcatacttttctttgtatttcacctggtgatagaaagccatgttagatatctctcctctggtcaattcctagacagcagtttaaggatagtattttttaattgatatgttctgtcaattggatggcatctcattgccactcaaaacagtttcctgttatgtttcagatccagtacatttttgttgttgtctaggtgttgaggggatgggtaccattactgtctgcaaggcataattaggatttggattcaattcaaggacacaaaagaatcattgacaagagccagctgagagaaatgctgatgcaagaaaacgcatggggaaaattacccaggtagatgaggttggtcaataattgatgggtagctgtaaacactttaaaattattaatgctattagcattaatcaatatttctgataaaaatccttagtttttctttcacaagaacttttatcagagacctggggtctagattgaatggataacacatggagctttatttataagtaaacaactctatgtgggtcctgactggccatatatttaatgcagccaataaattggtataaaaatgaaaactagtttacatattgactgacttgttaaaaaacctgacagtctcaaaagatcctcaagcctgttgtataaataaaattttctcatcctcataacatgtggttaagaatcaggggagccacataaatgtatgtgacagagaacttctggaaaaacaggcgaagaccctcatgcacgcagcaccttgatggcactgctcaatctccgagctcttgggttgtaacaagatgttggaataaaggcctgggggcacatactgccctacagaagacacgaggacgtttctaatagttagtcctcatggttaatgcccaacaggggacctaaataatgctgaatttgtgatataggaggtcatgtgatagtaagttctttcctctgagaatcttcaattatagtcatgaattgcttaacaactgggatatgttatgagaaaggctttgttatgcaatttcatcattgtgtgaacatcacagagtacacttacacaaacctagatggtatagcctactacacacctaggctatatggtatggcctgttgctcctaggctagaaacctgtacagcatattattttactgaaatctgtaggcacttgtaacacaagagtatttgtgtatcttgatacctctaagcatagaaaaggtacagtaaaaatatggtattaaaggttttaaaatggtacacctgcatagggtagctccattataatcttatgggaccactgtcatacaggtggtctgctgttgaccaaaaacatcatgcggtatatgactgtatcttaaaaatttagtaattttgtaaattcccagaactgctttcagtagtagacctgatcgtatcacttctctgtttgaaatcttcctgactccctataatctactgtagtgttccctaacctggggcacaaacccatggggcacattggagttaccatgaggggtttgtcccctcataaaacacactctttatgcttccagcccctgccagtagcacataattgcatgtatatttctcaactatatgtagatgttgttgtaatttataacataagaatttgtttcaaaaagttaccagattcaaaaccccttatatctttgtgcattttctcaaacaatggagggaatctatgaaattttttttcacattgtactgtggatgaatgtgcgccagaggaaaaatcggtcttgatccacttactatactctgtaattctgtggcctcttttaggtgaagctgctccagattatcgggtatggtgtggtagtggcctttactcttctcatacttcttcttgtactggtactgaggggaaggcggcaaaaaaggcacattgatggagaagctgctcagcattcctatttttcctctttagattagacgtttacacagcaccattgtcaagatcaaactaaaaatggcaaacactaaacaggaggttaagaaaaagttttaaaaatgaggatccaagttcagtattgtccgttaagatgtaaacacttaggttatgtggcttgttcaaagtaggtgttataagtaaaaagttaaaagtgaaagaaactattccagagggtatttctatgtccttagagaaaagggaatggttaattggagggcaaagtttaaatattttttaaaaagaagcatttttacattctgagaggtgttacagacaatggagaattggtagattaatgttgtcatttggaagaatacactcaaatgagaacagttttgtaataaatctagggtatcagtagcagagaagaagatgcatctgggctcagaaagaatttagttccaaatgggtaaaacaagctgtttctggagcaaatgactgagcttacagaactggcaagttggcttgtattcaggacatgattcatgatcagagactccttcatgtcagtcacgggtttgtgaagtttcttcaggtcagccttgtatttaacctgtgtgttatgggggaagaaaggaaatcacgtaaataggaaatggaacagcactaatggaaatcaaagtgagatagcccatcgtcaaacaaatgctggagatggtgatgaaaaatcatacctcattcatagtagccagaaggcagaaacaacccaagtgtctgtcagcagatgaatggataaacaaaatgtggcatatacatacaatggaatattatttagccataaaaggaatgaagttctgatatatcctacaacatggatggaccttgaacatattatgctaagtaaaataagccagacaccaaaggacagatactgtttgattccatttatatgcactctctaaaacaggcaaatgcatagagacaaaaagtagataagaggttcccaggagctgacgggaggagggaatggagagtttttgcttaatggttatagtttctgttggtatgaaaacattttggaaatagtgacagtagttggataatattgtgagtgttataaatgctactgaattgcacacttaaaaacagttaaaatggcaaataccatgttatatattttaccacaattttagaaacatacctcacttgcaagattattagcatctttcatgactttgtagagctggctgtcttttggattgtattttggtgtcttgcccttttctttatcgaaattttctcggtatttaacctaacagcaaatgcaaacatccaaattattcctggacatcaatcaatttgggaattggggaatagtagaaacacaaatgccaaagaatatgcattgtacatagagtgatcatataatctattatccaaactgggacatttagagtaaagaagacactattaataattaagaatgacaagacaacaggcattcaaatatatgatcactggccttgctcatttttatattattccaaggtataaaaagtaatcacctctttctaatgcaaaacaaaaaaaaaaaaaaatggaaaaggcttcaggctaaattcagagatgtgatttaatgtacttgatttggagcattttagcactcctaactagcaaaaccaacagcaatttaagtctgtgaaatccaaagaagggctgtaaatgatcaagaaggttgaaaaataaagaatctgttaaattaggagaatttattgttattttaaaatagtactttggctatatcatttaaaaattattaaacttggccaaaaatggtataactcctgagtaaacaaatatgagagtttgggggttaatggcttcaagtgtgatttcagactagaagtaggaaaaaagtgagatacttcagaataatgagaaaaaataagattaaatatacttttagtatacataaaaataagtttaggtaggcagagggctaaataactccaatttaaaaaataagcacaatgccttgcactaatagttgctcaataaatgtgatttgattgaatggaaggaagagacagtcattatgtctaggtaaaatatctaaagaggatgatagccaggtgtggtggctcatgcctgtaatctcagcactttaggaggccaaggtgggtgaattacttgagcccaggagtttgagaccagcctgggcacgtgctgaaaccccatctccactaaaaatacaaaaattaactgggcattgtggtgcacccctgtagtctcagctactcaggaggctgaagtgggaggatcacttgagcccgggaggtggaggctgcagtgagtcaggatcgcaccactgcactccatcgtgggcaacagagcaagaccctgtctcacaaaataaataagaggatttatttataggagaattcaacagaatggaaagtgacagaaacatctcctaattgaaaaacaaactgatgcttttgtcaacagtattgcagaattaaggccagaagtagaattctactagttattcactctaggaggaatgaaaactgagctgtttctagatgttagccaaccaaaagggcaatatttaaccctcagggaatcctagagtttctgttattgttaagatgaaagactcactaacaccagtacccctcatggttcatcactgctcttcacctcccccaacttgacacatccagcacaacagacacaaaataacaatgaaatctgccacatcagagaaaatgcattcacaatgctgagactcctttactttgaataaatcctcagtggaaatgcagagaaaaaataagcatgcagaacagttcagcatgatgcaggcacactgagacacacaaagtaaaggaaaaagaaacgtaaacaaatgctacaatggctcttctctgaaaaagtttcactctcaacataaagaagtggaaggcctgctaaggaaggtctgaggtgtgagctggtgtctggaccaaaggcaacttttcctaagagatatagaagtccataaaactaggagatgttcccaagagttgtgaaacacagaaaagcaaaccagatatgcagagtcagagtagggaagaaaagaagcaaaagcccatctcaaatgagaataaaatctgctttttttagaagcatactaaaagtcctccttctgtcttttagaagatacttgtttctgaagaggtatttttcaagcagcaatcccattgattccacttcagtttctttttcttctgttaatttcaagttaacttcaacctttttaactgaaaaaaagttatggctcccttctccataggaagtcctctaaacaaatgcagctttttacaactactaatatgaatctgagttcagcacttttggccttcctttttgactggatcttcttaaaactagtatagtttgaaaggtaaggacatgtaccaggtttaggactctaggaattcttggaatggtgtttgactagggagtaatgtagtaaaactacatacacttggcattagggaatggtgaagctttttcccattaaccatgggagctaagaggcaactctgcaatgccatgtctcggcaagtggcagcccccggggtttataatcccatcaggctcagaaattgggcctattatggatgtagtataggaaagtgattttgcattaattatatttttaggagtttaattgtatttgaagtttaagatctaattttttagctcctttttattgaattgagatgtatactggtgcttctaaagactgaagaacagtcccgagaattagaaaagctattaaaagtttatactgttgattcatagaaggcctgaactgagaaactatattaaataccaatcttcagtatattaaaaatcaaaaatggcagataacttcagaagaggcagaggtttctttggttgaagatgagattctcagtttgttttcatttcatcatttaacttgatcagtgtcagcaacctaacatacacatacattaggagtccatctctgagtctagtctaccttcctattccaagtggtatgttccagatggaaagtttcatgcaggaaaagaagggtgtatgcaaaagtatatccttcaacaaatttccacagcaatctacacgttccaacacaaaaatcaacagaaaagaatgcaacctggtcagtctcctgaccaatgccaagaaagtagacaagaatcagaggaagacagaaataatggcttgctggtctcagtctttcttacatcactgatgtgtacattaattttcttaagatgcctcatcataggggtgtcataagatgcagcgccgtgccctctcctttggcctttgaggtattccgcctagagtacgcagcaagacagcaaagtcagaacagggaaagcccacacacagctgaagcgcccttgggcccagggccacaccatgaagctgtcaatccggagaccagcctttcacaggaagtaaatgggacccatagggtcccattctccataccataggattcacttagtactagaaataggagcctcttgattttcaaaaacaataaagttttcaaaatttcaacatcatagtcgtttgtttttaaattataatgatatgaccttgtacatttaaaaacattaactttttgcattaataagttcttgttacatctcattactcttagagattccactgtttttttgttggtggtggtgatcccatatcttagtttcaaatacttatacaattccattaatttataataaaatatgttacataggaattttaagtttaaaaacttttaaaaaataatatttgcttttcatcagtcatctgaccctcttgtgttttcataattctaacttgttctgtcacttgacattactgcattatatcttccaaaagattggaatcccatgtttgctattgctgaaagtcagtcactcacgacaaccaaatgtatatcccaaacctatttcttcaaacagatacctgagaggacaaggaaaaagaaggtaggatctgtaaattggaggagaaatgagatattcttaagctaaagtcctataggatcaaacttgcactctgataggtctggtggtagatgatgggatctctgagctaaagtctgaaaacctgtcataacttggggaattttagataattggcctaacaagggaaaataagtcatgtggtaactgggtttgggcaacacatttctgagtccatttgcttctcaataatatgagatctgcaagaatgtggcattctccatcagcaccctgtgcataccctgatcaaacacttgccaaacaaaattttaatgatttatccatggacaagtaatctgaagacatctgctcatccctacttcctagcccgggcagttaatatatgtatgtttaatgaaaaaaaaatgaatattttcatctggttggattctagaagttagaatttcattgctcttcatgttaaatctatcccaggtgactcaagtatgaatcagaccccgaggatgaaactcttaaggcctggggagaggttccagtaggatctcatgaactgatgtttttgtcacataaagatagttaagcacacagacacccagacaaatgcccataaatggtaaagtggagaacaagaaaggtctagacagcttagagggaaacgagaaaaggccctcagtgcactttttataactcttggaagctttgcagtactattacagacccagcatccctttgcattttcaatctggaaatcacttcttcctgcaaggtcttttataatctcctcacatgagagccaccagtgcacccatctgcattacctggctgctcagcttggctgccttcttggccatttctatgtctgggcgaccgagcatgcttaagccatggctgccttccttgcggtgcttggctctgtactccacctgaatcagagaaaaccaaaatgggcaacaggtgatggttgcctggcatgccttggcaatggctgttggggactggggacattttcatgacacccttacctcactggcctgtttggctgcctgtgtggccttcttgatgtctggtcgatcagccactgtggtgtaatgcaggttctctttggcatcttttctgtaagcgacctttattggggaagaaaatgtttactcaagagagaggcttttttttttttttttttttttttttttttgagatggaatctcactctgttgcccaggcttgagtgcagtggtacaatctcagctcactgcaacttctgtctcccggattcaagtgattcttctgcctcagcctcccgagtagctggggactgcaggtgtgcaccaccatgcccggctgatttttgtgtttttagtagagacagggtttcaccatattggccaggctggtctcgaactcctgacctcgtgatctgcctgtcttgggctcccaaagtgctgggattataggcatgagccaccacgcccagccgagatatgctatctttctaaaagtccccattaagcacaatcagcttttttccttaaacccaaaccaattctcgccactaactttttgaaactaccacagaggaattagagtgaccacacactggaacaagagaatgcaccaatctgggttccactgcttcaaatgggcccccaagagtgttgagagggaaaacttacatcactttgcttcttggccacttccatagcatgtttcacctctggtggctccagcatgatggagtagttggattttcctttctccttgacaaacttctttttgtaatttgtctaaatagagccagaattacttttatgagtagaggaagctgggaacagagttggtttacttgaagaactgtgaaatctccaggaaaatccatgctccccattttggcgtcagtctgggacttagataagacccatattctagttcttctctgtcatttgtgtcctgcaacccaacactagaaccacctggcaatcttcggagaacctgggtagaggcaaattaagctcttttatttactatttctaccttttaaaaatatatggaaccatatgggactcatataataccaaggttactacagcattattgataaggatagagcaggcagagattactgaggcccaaagaggtagttttacctttctaaaattgggtagcagtttaataataggagaggccactcctaatcaacaatgtttccttctgttattaataggttagtaatatctgatatggctagattacatgtcctgtagcaaaacccacatttgccataattgccagaattggaaagccaataaatactgggtcattttaaaagtcagagtttaagattcacatgtagatattgatggtaagagtgaagctacataaaggaagcaaaaggcaactgacattatttcaccagattctacagtcaagtggcattgttgctgccaagagaccggtggttgatcacttacatcactgacatgcttggtcacttccttgacgtgaacagtgtcccgggtctctggtagtgttgtgtatgagccctgtgccaagtgcttcttgacatggtccttgtacttgttctgggggaatccatagagagctcattaaggcatctgcctggggcgttctcccaagagggaagcagaactcatgggcggctgggggttacctcagacaccaggttgctgacagtcttcgccagcaggatctgaggcgtgtcaggtacggcatggcaggttcctctttccttgacatgtttctctttgtatttcagcttcaggggcaggaaaaggggcatttctttagctctgctggatatcctacatatttttattacaccctcaaaccagtagaacagcagcgttgacaatactaaactcaataaaagatgtgatacttgcaaattttgggaaatattcaaaagggttttttccttatctctagcaagttgtggttttaataacaatcaaaatggatctcgtgatgaatctttatatagtcacacttacgttcacagcacgctcagatatgccatttgtccctcccataagccctccatgagcccattattattccgtctttacagaggaggaaactgtagtgaagggaaagtatgatcccatagaaaacaaatcatggcgtttccataaagagtccagccaggccttcagggtcctaattcctgctgtgtgaactctctgctggtgcagtataaatcgaggactgtcacctggatctaatggcccttgcactgctgctgccctgcttgactgctggcgcccctcacaggacaggccataattcaggacccatacctgagccctgatggaagcagctcttctccatccttccctggtgtccctggggactgtaccatggaagatggccctgagtgaggttaggcatcatggaaggaactaggtacttacatcactttctattaaagtattcctgagggcgagcaccgtgtttttgtcatcagtgacagaaagcttgcaacccttgaggaactcccggtccagcttatattcaaactgtgatagaagaaaggcagaagaaaagggaagggtgacagcacaggaggaagctgggcatttgattaaacacacagggagtcctcttaaggagaggacaaagacttgctaccagaatgaggagaagagcttcttggtccctcactgcattttggactcctccttttcagcctagctgccaggaccaagcccctccatccccagtcttcccccagactctccccagcctcagtcagaactcagtcatttgtgtccaggcccagccaaaggagaataggctccatgggcaggtttgggttctgagctcgcctatcgctcccccaaccatcctcctctccttctcggatctcaaacgagcaagggttaacactcatgatagtggttattataaataattattcattgtatttctcaggtgcagtatgcagttacaatcgtctgtgtctctcctgtcttacatcgctttgctgcagggatgacttggcagcctggaggaagtccggtcggtcaggagtccacttccagtgggctttgttggcttcgtactgtttcttatagtccagctgtttttaacaggagagaaaggaatcacttgattcagtaggctaaattcataaacacacacatggcacagaggggctcttgcatttcaaaacatctcaaatcatgattcctaatgcaagaggaagccccaattgaaatttctgtacaatttatgcagctagtcatccactcagaggtcatctgttgggaccctgtggtcccgaaatagaggctaaaatttttaaaggcctccgggtgaaatgattcttcaatctctctagttctgccagtccagcctaatcatcttcagaatcgagtacttttaatttcaaactaaattcgggtttaatttttaccaaaaatgatcaaacactaggtatttattttctgccaggcacttttctaagttctttacaaattacaaaactaattaaatgaattataaaattttataaaattaattcacctaatcttcataacaactgcatgaaatagacagctgaagaactggatagaaaggttaagtaaacttcccaaggtgagacttagcaattggtggagctggaatttaaacccaggcagtctggctgcagaggggcttgcatgcttcctagacccttcagggctggagaactggctgcattgggccaaatctgagccacagaagtgtatgtaatttaatttgagtgtccttgggaggagcctgcactattaggcacatttctttcctcattctttctctctttttaaaattgaggtataatttatacacaatacaatgcacatgcttttatgtatactatttaataaggtttttttcccctcattttattttgaaaaatttcaaacatacaaaaatgttgcaagaatattacagagaatacccatacaacctggattttgcaaggtacgttttactgcatttgctttatctcacatctgtccttctatccgtctgccctcaatccatcctcaggatacgtacaagctctttgccagctcctacagggattccagtttgctagccctcataaatatatgtcccctctagcactagtgggtactaattcggttacaatggtttcattgtataaccatttaatatatttttaagaagtcagtgctcatctaaatgcacaaaattatttctgtagttgaggccttaagatgctgcacccaagaagagagtcaacgcagggaatatctgagcaggaagaaggtctaggccaatgcctgatggcaccaaatggctcaatgttttcttcatcagaagaagcagattgtagagtttgaggcaggaggagagcacagggaaagagaatgaaaaatgctcaggcactttccaaaaatgcaacctacatttcagaattaaacgtcccatttctcagccacccaccgcaaaagctgagtgggtgtagcatccatggcatgggatgaagcttcctttgctcttccctatgctcctttgtgaggaccaatgcagcatttatattttagcatcattgttcatgctcctggggcctgactcttgctttggaatcaatcactagagctgaattgcctgaagagatgtaaaaagaggccatgtgtcctacagaagctggtaaatcccccaccatgcttggggaagtttctggaacttacattggtgttgactttgtaggcgtccttggctgctttgatatgaacagcatctggctcaatggtgcagttggatttatttctttggtatacttctttgtatttcagctgtgggaggaaacacagtgacaagattaatttttttatagcagcatactgagcatcttaaaaaacaagaaattaaatccatgcatgactatagtacacaatgctccttaagacggaattttaaaaatctgctgtggagcaaggatacagccatgcagagatgcaccttcctatctcagatcagggcacactgactatggtcatcagtgttgccatataattttttttttttttttaacagattctctctctgtcacccaggctggagtacaatggtgtgatctcagctcactgcaacctccgcctcccaggttcaagcaattctcctgcctcagcctcctgagtacctgggaccacaggcatgcgccacctcacccggctaattttgtattttagtagagatggggtttcgccacgttggccaggctggtctcgaactcgtgacctcaggtgatcccgcccacctcagcctttcaaagtgctgggattacaggtgtgagccactgtgcccagcctgccatataatttttgtttctgtgcttgtgctgaaaggaccagttggaaccctattcattcaggttttcctttccccaaatcagcaaatcttgagttcagaacatcttgataactgctgatggaagagaagcctttccctaccagctcacccagacagaattagtcttgctctccttctgtgctccggcagttatagctattatcatatcgtgttataattttttttaatctgcctattctttccattaaggaccccttaagggcaaaaactgtttatcatccatcatctcattcctagtgtcaggcacatagacaatatttgatgaatgaatgaactgatgaatacagcaatcattctgccttttaaaaatatatagaactgtatattgtcattgctggagacatacctagcaagttttggtatatgtgggtttggataggagggaaaggcacagagaaggcttagcatctgcaggcccaacaggcagtttttccatcctgggcctgggacttccagcttcacccacttttgctcttcttaaatttcagggtcgagggcctcgatctgggctttttcattaatcgttggggaaggatcctaggttttaatgtgactaaggccaaagtaaactgttccgagggagccatagtggggtttactaaactgatcataggaatcacaattttcctggctttgccatagacctagtttaccaatttacttatcagtatctttaggagaaagtcgtggaaattcatttttaaaaaatcagtacctcaggatatgtttaagccacgtggagacccatctggggagaagtcccaggcatgtggagaggccacatgaaggggttcctgtctcgtctacacaatagcccagctcccagcccgcagccatcaccaatggctagccatgggagtgagccacctggatgtcctggcttgactgagccccaggtgtctgccagcaacatggggagcaggactgttcagctgtgtccagtcaacttaccgaatcatgagcaaaagagatgactattattttaagccactaagttttagggtggttgttacacaggaatagataactggaccagggtttgttacatctcattagaaggaggccaagatgagagggactgctaaaccattctagtacttacatcactgacttcatctttaaccttgcggacatgcagcaacatgggtgtgtcgtggattgtggtgtagcctctgggtttggccttgttgtattccaatttataaaggatctgaaagatcaaaaagcagaaagacatcatgtcatgcttctcaatgtataatatcaaaatataaatgcaaagttttttcctgagtgaatataaaggaaagagaattctatgaatttgacaggtgctttcatgctctctgctaagacttcagtgtttccagctggcgtgtctgccagtttggtcacaacaactctctttttttctttcttttttttttttttttttttttttttgagacagagtctcactttgccacccaggctggagtgcagtggcatgatcttggttcactgcaacctccatctcctgggctcaagcaattgtcacgcctcagcctcctgagtagctgggaccacaggcatgcaccactgcatctggctaatttttatatttttagtagagatggggttttgccatattggccaggctggtctcaaactcgtggcctcaagtgatccacctgccttggcttcccaaagtgctggaattacaggcataagccaccacgcccggccacaacaattctttattggggaggagaatcctgtgcataacaggacatctcgcacccctgcctccctcccactaaatggcagtagtctcccagactttgtgacaatttaaaatgcccctccatgtttgcagatgccccctgagtttgagaaggtattcagtgtttcttgcacttacatcgctgatttgtttgttgacttttgtagtacgcaggtgttctggagtatccacaattgaggtaaatttgtcctttgatttttcatagtttttcctgtatttgatctaaattgtggaagagaagaaagagctctaagaagttgtagagtgggctttaaggtatctaattgtcctcttgaaacaccagagtgggagatggtatctagctttctctttaattcctaactggaaatgtttactataaatttgtgtctgatagcaaaagtgaaatggagtgagcagatgatactactactaataatttcctttttttgtttccctccgagacggagtcttactctgtcacccaggctggagtgcagtggtgcgatctcggctcactgcaacctccacctcccagattcaagcaattcttctgcctcagcctcccaagttccaatatgttttatacacatgtactcggaggcccccagaggttacgagactgacccaagggcacatttagaccaaatctcagagcaggactagaacctgttctctggagtctgacaaatattgttttactcataacatattgtattgaacatgtacaatctccaaaggcatttttccatgtcaaagatgaaacagggatgtaaaataaagaatgagtatatatgaagtatttatcattttaaaaaattcatttgtttttgcaattttcaagtcataattattttcatgcacagaagctgttttaagcaggacagatacagagagcaccataaaatttcatgcacaactatttgaggatcatataaggacaaaggaggaagttcaggcaaacaggatatttataggaggagaaatgaggaggttaagctcttaattggagcttaacctcctcatttcacatattgatttcatggtaaactaaaatgacaaaacaagttgctaagaggaaagctcaattaactttttttttttggtctgggaaaaatggtattattactaacattgtgtctggtagttaccaattatcactgtttattgctgcatcaaatttacctttcagcatgtgctggaaagtgcatgcttcagttggccttctaaaaaggcattattatcagagacactgttaacctgtgtgtgtgggatcagatgtgctggaaataacctagcaattcagcatcaaagtcaagaggcgccatgaatatatacaatattcatagagctgcacggtaatcctcatctccctgcaacagttgtagtgataattgaacaagagacacattagatgaaaacattaaatattcagaccttttacatgctgttgaatctacttactatcttcaatctctaaggaatctatttctttgaggcaaatactgaaaagtataaattaatgttataccactttggaaataacacttgaaagaatcagttaattttattaagagttctgaaagtgtcagatgatgtacggatgaccactgtcccatcacctttggccacattcagagatcatttacaaggaatgaatatttacatagctttaccatatgaagccagcatgggcagggagtggaagaggaaatcaatgaaagcatacaagggaatgcatccaagacttcttctaaacctccttcttcacatcccatcagacattacctggctccacatatgcgaattgtagagagcagtcaacatatctggacgcagaatttcattacatccatgttgcagaaacatcttggcactagatttatattttctctgtccatgcaaagagcagtgaagcacaaaagagacttatgaagacagaaaagaacacggctctatatcccaatcacctctgagtgaagagatgtaggcatacacactttatgtactcacatatgtgcgggtgaagacatcaaatacattataatgtgaagcagaatgactgcaatgcttgcggttggccattcatagtccttgtgaatggggaatgatacagctagtttcacttacgttaccaccaaaatagctttatagaaaagaagacatctttggaatagaaagatatatagtaaggagttatgtcttctttccttccattaatttttgtttgttttttgttgttgtttgtttattttttgcttttgcaactcaatctgcagtttacagttgcagttttcaaacaggttctccagaagagtaaaggatgggaggacccagcttttcctttcatcttcaccacagcacaagtgagaacacagagcatggactggcacactcaaatagctgacgggctttttgggtggctagacagatactttgaaacagaacaacccaatatcataggcagaacctatgacatccttgcagcagacgggatgacatctcatgagaaactgggagcacagtcctgcctgggccaccggccag

SEQ ID NO: 198 - DNA, 61776 bp, Homo Sapiens
tgctcttttaaaaaatttatctatgtaaacacatcttaatactaatttgagttactacttttattctttattgtcacattttccaagttttgcgcattcaaacttggcaaacatcatggagatttgtacaaacatacatatacatatatacacacatatttatagccccagcttcctcattaaaccttgtgctcaggctcctgttaaaagaggtaaaatggtgagaagataaaaatcagggaaaacatgaataaatgctgactgacaaatcttgttgttatgaatttgtaaggcagacattttaaagcaaaatccattaccttgctaaaatttccactaagctacagcttcagatatttacaagaaaaataaatatcttttaacagacttcaatgtggtttaacagcaagctagctgaggagttgtattttgttgttatttcaggtaactttttattaagaaacagttaatatttcagtgattacaatttcaggtgttcaaaactcaagaagggtcatcattatactctgaagcagaattcttcaggtactcatctttaaattactacccaaatctatcacagtcacattcaggctttcaatttttaaaaacatttaatgtttggtaactaaagggtagatgcgattagtgtactctaggtcgtttgattttatttttttctgtaggagctttcctcttttgtgataatccagtcccaagttccttattattctgaataaatgaaatagcttctggtagacagtaattttctacatgaggaggtgattcctataaaaggaaaaataagtgattttttaaaatgatttcaaacatttacgtgatctggtaatagattttttctttaaatctcagacctctcagggatgaatctgacaaacttaaaggaaaacgcatattcattcctaggttccagcaaattaaacaaaatggaccctgtgggacaaagtctcaccttttatcaaagaaatacgtgtatggttcaggtagagtgggactagctcagatcttacaaacatttcatatcggtgtttttaatccccatttttgagataaaataaaaaaggttaaatgaaaacaaccaatgtcacataactagcaggtagcaaagccaaatttcataactgatctgactccaaaacccttgcattttccccccacaaccatttcccaacatagaaatggatcttttcctccttattataagtgtaataaaacttaattttctagcaatatggcagactgggcaacctgaaaatgaatcaccacaaaataccaagtaagtgccttttgattcaattcttccatggataacagctacaaattctgaccaaaatatattaaaagcaaccatagagcctggagaataaacgaaccaagcaaatggggggctggggacgcaaacacagtgtatgaagtaaactgcctgttaaacaacacagtactctttggaggagcaaaggaacaatagaacctagagtttcttttttagggggagataagggtcttgctgtgttgcccaggctggtggctggtctcaaaaatgacacattgaatacaagggaacaattcaaatgaccatcactgatttctcaacagaaacaatggaggccagcagacagtgaagtctttaatagaagaaaaaaacctgtcaatctataattctgtatcctgcaaaactgtccttcaacaatgaaggtagaatagacatttcatacaacagaaagctagaattgatccccaatcaacctgcactccaaactaaagttagttcttcaggctgaaggaaaatgttatcagatggaaactcagatcttcagggaaaactgacactcaaactggtatacatgagggtaattataaaataccattttttattttagtttcctcaaaatgcacagaattgttaaaagcaaaacctatttaaagtaaaatcttatttggggctataagatgtagatgtaaaatatatgacaactactgcataaagcagaggtcagcacactttctgtaaaggctcagacagaaacattttagattttgtgggatagatgatttgtgctgaaactacttaactctgccattatagtgcaaaagcagccatagaaaatacataaatgaatgagtatggctgttttccaacaaacctttatttataaaataggcagtgggccaggtttggccaggtggctatagtttactgacccctggtataaaggacaggggaagcaaatgaaccaacttggatgcaagagatctaccttttttcattttttttttttttttttttgagacagagtttcgctcttgtcacctaggctggagtgcagaggcacgatcttggctcactgcagcctccgcctcacaggttcaagtgattctcctgcctcagcctcccaagcagctgggattacaggtgtgcgccacgacacccagctaatttttgtatttttagtagagacacggtttcaccatattggccaggctggtctcgaaatcctgacctcaggtgatctgcccaccttggcctcccaaagtgctgggattacaggcgtgagccaccatgcccggcctcaggaagtaatttgtaatctacatataaacacttctccctccaaaaggtaaatatatttttgctttagaaggccaatggataaaataaaattctaaaaatattaaactaatacaaaaaaagccaagaaagacaaagaagaacaaggacaaagaacaaatagaaaacaaacagcaaaaaaccccatccctaaatccaatcatatcaataattacatgatggactaaacactccaaagaaaaaaaaagcaaggcccaactatatcctatctacaagaaagccattttaaatatatgacacagacaagtttaaaattaaaaaccatgcaaagagatatcatgacacagagtaaacaggaaaaggctatattaacctcagataatgtacattcaaggcggagtaagcccagagatacgtgttataacaaaggatcaatatgtgaaaatcaaagaaattatatatgggtaaacaactagcaacaaagtttgaaataaatggggtaaaagctgacaaaattaaagagaaaaaacagacaattccacaaacagctggagattttagtatcagtaattgatataactaaacaaacaaaaaaacccacatacacagaaaatctgatcaacattatcaaccatattaacctatttgatatttttagaacacaacacccaacagctgcagaatataaaatctttcacatatatgatatgttcattaagatagatgaagctgggtgataaaacaagtctcaataactttaaaagaattaaaattatagagtattttctgtgattacaatggaattcaatgggcaatcacaaattaaaaagatagaaaaaaaaatcctcttatatttaggaactaaacaacagactcctaaataagccagttataaatgaacacaagttgacaatatcaggaataaacttatttatttatttatttatttatttattttgaaacggagtcttgctctgttgcccaagctggagtgcagtggcgtgatctcgtctcactgcaacctctgcctcccaggttcaagcgattctcctgcctcagcctcccgagtggctgggactacaggcacacgccaccacaccccgctaatttttttgtatttttagtagagacagggtttcgctatgttggccaggctggtctcgaacccctgacctcaagtgatctgcccacctcagcctcctaaactgttgagattacaggcgtgtgctaccgtgcccagccaggaataaacttattacactaaaaggataataagaatattatgaagaactttatgccaacaaatttgataagatgaaatggatatattatttgaaaaacaccagttattaaaaactgacataaaatgaaacagaaaataggaaaagcgctgtatctagtaaagaaaattcgttacaaaaaaccacatataaagaaaactccaggccgggtgcagtggctcacgcctgtaatctcagcactttgggaggccaaggtgggcggatcacctgaggtcagcctcaggtcagcctggacaacatggttaaaaccccgtttctactaaaaatacaaaaattagccaggtgtgttggctcatgcctgtaatcccagctacttgggagactgaggcaggagaatcacttgaacctaggaggtggaggttgcagtgagctgatattgccccactgcactccaggctgggcgacagagcaagactccatctaaaaaataaaaatacaaaaaaagaaaactccagtccaggtggctcatgcctataatcctaggactttgggaagccgtggggatcacttaagcccagcatggtgaaaccccgtctctaccaaaaatacaaaaattagctaagactggtggcgtgcgcttgtagtcccagctacccaggaggctgaggtggaaggatcatttgagcacaggaagtggagattgcagtgagctgagatcaagccattgcactccagtgtgggcaacagagccagaccgtgtctcaaaaaaaaaaaaaagaaaactccagaccttcaaacattcaaggaagaaagaggcatcttacacaaactcttcgagaaaatcaagggagaacttcccaacttgtttgtgatgccagcaaaacgctaataccaaaagatgacaaaaacattacaaaacaatgagaattacataccaatatcccaccctgaaaacaattttaaaaatttttactcaactaaatctagcaatatatacaaagattaatatggcgtgatcaagtgggactgatacatgaaacttaacatttgaaaatgtaattccccatagtaatagaaggaaagagaaaaaccttataacaactccaacagaagtagaaaaagacattttataaaagttaaccccaattaatgatgaaaaagaaatcttagtaaactaggaataaaaggactcttcctcaatctggaaaaaaaaatctatgaagaccctatagctggtgaaatattgaacactttccacctaggctagggaataaagacaaggaggcccaatctcaccacttctattcagcagcatacttgaggtcctagccacataagacaacaagaaataaaaggcataaagaagggaaaatctacaaatctctttgcagataaaatgattgcttatgtaggaaagcctaaggtactaattgtactaagtgaattttattaagatcatagggtataaaagactgacaggcaaggcacagtggctcacacctgtaatcccagtactttgggaggccgaggcaggtggattgcttgagaccagcctgggcaacctggtgaaaccctatctctaccccttccccttgccaaaaaaaaaattagctgggcatggtggcacatggctgtagtcctagctacttgggaggctgaggtggatctcctgggcctgggaggcagaggttgcagtaagccaagatcacgccactgcactccagcctgggcaacagagtgagaccttgcctcaaaataaataaataataatatacaaaatttatattcttttggattggcagcaaattgtagaaaaaaatctaaatgtaaatctagaaatttttatttacaatagcatcacaaaataggaataaatttaacaaaagataggtaagttcccttactgaaaaaccacaaaatgttgctgagagaaattaaagaagacctaaatagagacattctaggtttatggaatagaatgctcaacactgtaaagatgtttactgtcctcaagttggtctatagagtcagtgcaatcctaatcttaaccactctaggccttttttttttttttttttttgtagaaactaacaagctgagtctaaagtccatatggaaatgcaaaggacatggaacagctaaataaccttgaaaaagacaactaaaattgtagtcttaatactagcttcaaaagttgctgtacagctacagtaatcaagacacagtaggaaaggtatcaacaagtagataatgaaacagaatagagactcacaaaaatacgatcatttgattttttatcaagatgccaaagcttttgtgggaaaggaaaatctgttcaacaaatggtgctagaacacctagatatctatatggaaaaaaaccagccctagtccatacctcagagcattaagaaaaattaatttgtaataggtcatagagctaaacataaaagctaaaacaataactttttagaaaaaaatattaaatacacacacacacaccaacaaacaaacaaacaaacaaagagaccatgaaagaaaaagtgctcgatgtcattagtcatcagggaaatacaaattacaaacactctgtacaaattacaatgtgctcccactataaacctaccgcatggctaaaaatcaaatgactgccaacactaaatgttggcaaaatatggaataaccagaaggcttacacagattgagtatcccttatctgaagtgcttagaatcagaagtatttcagattttggaatatttatatttactggttgagcaaccgaaacccagaaatcagaaatgtttacgattttgtaccatttctaacttttggatttgggatgctcaatctgtatattattggtggaaagtgtaaaatggtaaaaatccctgtatatttttagtagctttactaatgataaccaagatgacaaacagctactaaaaatatacaggcttttttatggacatattttttcatttttcctgggtaaataggacagaattgctgtgtaatagaataagtaaatatttcgttttttaagaagctgccaggccttttgtcaaagggatttttaccattttacacttcccaccaataatgtacagattgagcatctcaaatccaaaagttagaaatggtacaaaatcctaaactttcgagcacttatgtgatgctcaagggaagtgcttattggaacatttctgattccaggagtccaagggtccatcaataggaaaatgaatcaactatggtatattcagacaaagaaatactactcagcaataaaaaggaatgaactactggtatacactacaacttgaatgaatgtcaaaaacatcacgttgagtgaaaaccttagataaaatcgtggatactaatcagtatgccctctgctctataacggcttcacatttgtgttttaggcattctattaaatcctgagcaatctccaagcacagcagcaaaatcacaaagctgactttgagtgttggcctccccttatttctgtatcatcccagttgaaatccttcatagattatgattatgaaatctaatccttatgattatgtgtcatgcctgctgactcctgatggccttttgggcactctggtgtcagaagatttttcttaccccattcaaattacacaacacaggccaattctgaatatgagagtagtaagcccaccatatagcaaatgcttaaatttaccacagtgtctaacataggtatttaatgtacatgaaagcaaacagtcaagaaaactaaaggacctttggataaatgtttctccttggactcctggaatcgatttctgctttatattccaacattttaaagggtatttttaaagcctttagaggtacctagatttttatactcttctcatatttaacttccaagctaaatgtttacataatatgttcattataataaaaaacacaaatagaataaaactgaaagggctggaatagaagagaataacaggagactaatcttctactaatcatgagctgaaggttttgttgtgcagttacttatctatgcacataaacgtatctctggtaatgaggaggtcaaggatagaatctcacaaacctgcatgagataatcagcaatgtattctgttctcaagcagtacacgttctgggcagcagcttctgctatattaactcctgagtcatctggtttcagtttattcaagtcagaaaaaagatgtgtggcctctttaaataaaggtacagaatgaccaggtagcacctaatgaaaaaacaaggtagtatcacaatctaccagtattccaaagtagttcagctgtataatgtgtacttaaggattaccatttcaaaaagtagagaaaatgaagaactcatcatagcaatcttggttagatgattattcatgtaaaaaggtcagtaaattaatttgatacaaacctttgctcctcctgactgaagaaggcgtttgaagcctgcttctcgagactgatccacatgtaaaataaccttccacccactaaatgctccctacaaataaaaaacaatcagtggtgaaatcatttggaaaataacaaaataatacagataatgcatgattttatctgtagacttagttttgtcaataaatcttataaactttacttttgccacagtataattatctctggccagaacactgaaacgtgaatccatggtatctggcacatagtaggccatcaagaaatacgtgaggaatgaaaaaccattaatgattaggtaacattaaaacaaagcagtgtgattgatgtttagtcttttctagtatttttttcttttgattaatcaagggaagagcttcaagcagagctccttaggttagatgaagcctgcgtttcacttctcttaaaaatgtttacaaactggaaacaaaatatttaggaagggaataacaactaacaaaagccagtggaattactctaaaagagagggtatcatggctaataaggatttggagatatcagagaacttagaatacaacatgaaagactatttaactcaggggttctgataatggtttggctgtgtccccacccaaaatctcatcttgaattgtaatccgaatgataatctccaagtgttgggggagggacctcgtgggaggtgatcagatggtgggggcagttccctcatgctgttctcctgatagtgagttctcaggagatctgatggttttataaggggtttttccccactttgctctgcacttctctctcctgccaccatgtgaagaaggacgtgtttgcttcttacatgactgtaagcttcctgaggcctctgtagccatgtggaactgtgagtcaattaaacctctttcctttataaatgacccagtctcaggtgttgcttcatagcagcgtgagaacgaactaatacaattaacctttttgtaagccatggatccctttggcagtctggtcattagactactctaaataatagctgtattgagatataattcccaaaccttatgggtgatttttagaaaatgttaaaattaaaatataaaggattacaaaaggaagccattttattgaaagttatcaaaatattaaaaacaaatttgttgtgtaattatagatgtgctttatattaaagtagcagacaataactaatatggctttcagtgctttgacaaaacctcagatatgtggtcttctggccaagtgtctgtgatttcatattgtgggagcattccttatatccctggggttgcagctctctgtttgctgtggctgaaccaaaacagaaaggacatgctgatttctacagaagttatgattccatgaaagaatctgagatgaagagtgctattatgtttcagagtgcaaagtgattttggaatataaagaatttctttggactgaatcattaatacacagaagtttgtctttgacttgtgttcctgaactatgaaacatgaacatgtggcctaatagtttctcttgataaatcaacagttaacaaataatataaataactaaagtactgatgaacacaaacagtatttcaagatgcttgcaattacaatgcaaaacagaaacatgtgatttctgttagtgcaaaattacaggtacagttgatagtgttgtgatttgttgcctagacctttcattaaaggaagtgctagttttctcaaagcatgatgtaggctgattaaaatttaaaaaaaaaaaaaaaaaagaccggaagtgctaattttcaattagaggttagtaaaaataaggatgtatttttctccccatgcaaagtacatggccttcccagatttgatctacaaattcctttgagaaggtctgtggactcaggtcaagaacccctgacattagatgctgaaaagattctttggaagaaatgcaatatgggccacattttacatatataaattatttttaaaagagccatcaaaaatttggggaaaaaagacaagtagaatcattatttcctgaagcacattctcttttaaaaaaaatgtgaaagagtcacaatattgaatgctatttgtattacctatataattgtgttttaatacctcaacaatgccagattcttgtctttgctggattttttttctccatctcattgctgcaagtgctagtcttcgttgctgtacattgattccagtcagaacatcaagtatggaactacttccccattcatagtcttcttcctagagaatttgtccaacaaacctgagttgttacagtctggggagccactgtgcaacatacagggctcctcaaggagcccaaagtctaataactgttaaagctatacatttaattgttacaaatacagacagtactaagtaaatattgttttatgagcatggaggaaatgtagattagtttcatataagagtcaagtatatttggcttttaattagaaatcagaaaaataccacatacatttttaagaaacaaaatgatagctatatcttggcaactggtaatattcagatggacaaatttcacctgctgtaagactaacttcatgaaaggacacagtctcagaggaggtatgtactgataacttgattatctgtctatgtagtaaagatgaaagcttacaatgagataatcttgaaactttctaagaaaatgttatttcaattaaaaacaacactaacattcaaattaaatcatttaaaaagtgattaaaggtgaacctggctctgcgaagtttcgttgtttggctttgttattgaaaaagctggtatactctaactggccatatttggttatttcaattttatgagcagtcagcaaatgtgatgaaatctgagatttacttttttaagtaaataaataaatttgtctgtttcttcctttagagacagggtcttgatttgacctcctgggctcaagcaatcctcccacttcagcctcctaggtagctgggactacagatgggaaccaccatgcccagctaactgtttttattttttctagagatggagtcttgctatgtttcccaggctggtcttgaactcctaggttcaagccatcctcctgccttggcctcccaaagtgctgaaagtggcatgagccagccactgccagccaacacttactttttttttttttttagatagggtctcactcttgtggcccaggctggagtacaatggcatgatctcggctcactgcaacctctgccttctgggttcaagtgattctcctgcctcagcctcctgagtaactgggattacaggcactcaccaccatgcctggctaatctttgtagttttagtagagagggtttcaccatgttggccaggcatgtctcgaactcctgatctcaggtgatccacccacctcggcctcccaaagtgctaggataacaggtgtgagccactgcacccggtggacacttgcttttaaagaaaaataaacttccacaaatctgaatacacacctgcacgaagtgtccagcagtcctgcaggcttcaaggtaggagcgatgaagcacccacttcccagctgccactgaggctaaatacttctcgtttcgaagtggatgtcccacaacaatgtgtgtacaggtgggatcaaagcactgcttttctatcaccaatccaccttaagcagagaaaaatggattgtactttattgattcccaacttctttctaggaaaaatgtaatctcaactacgcatagaaattatttataaataaaatgccccaaaccatttaaaccaaaaaaacttgacttacttagaattattttactttatatacatatatatatgtattaaaatgtttattatgaacattttaaatacaaaagtaaataaaatagtaaaatgaacccccacacatatactagctacctatattctaaaattatccaaattctgccacctttttttgcttaactacttaattttattctgttttaattttaatttttttgagacaggttctcactctgtcacccagactggagtgcagtggcatgatcttggctcaccacaacctccagctcaagcgattctcctccctcagcctcgcaagtagctgggattacaggcacacaccactatggcctggctaatttttgtatttttagtaaacacagggtttcaccatgttggccaggctggtcttgaactcctgacctcaaatgatccacctgcctcagcctcccgaagtgctgggattacaggcgtgagccaccatgcctggtcctgcttaactattttaaagcaaattctagataccatgttactgacccctaagtatttcagtatgcatctctagaatatatggaaattttcttaaacagccataatgccattatcagatctaataggattaacaaagattctttgctgtctcagtactaaatccttgttcaatttttcctgtttgtcttcacttggattgttataattaggatacaaaaagaaatagaacataaacatgagccacacgctgtagttggttatgtctcttaagtctcaattacaaaagcagttttcaagcaccgaatatgggtaaccagggagatggaagtaagataggggcatctgcagactttaaaacaggaggaaattttttatgagtggaaataatgtcggcagaccaacagagaagcttgggaagaaaacacacacagataaataagagatgaagcagcaggtgggaaaaagcaataattgaacctcttctcagatataaatgcatgaagcctgactttgaggaaagaagaaggcataagtaaacataagcttatgtaaagcatggctgttgatttatagcttagaggttaacttgaccactggttgggcagagttagttatatcaaggactttttttttttttttttttgagacggagtctcactctgtcacccaggctggagtgcaggagtgcagtggcgcgatctcgactcactgcaacctctgcttcccgggttcaagcaattctctgcctcagccttctgagtagctgggattacaggtgcccgccaccacacctggctaatttttgtatttttagtagagacggggtttcaccatgtttgccaggctggtcttgaactcctgacctcatgatctgcccacctcagcctctcaaagttctgggattacaggtgtgagccaccacacccggtcatatcaaggactttctaagattttaacaaaacattcaaactcatgatttaagatgactctaataataatagcagcaacaccttctgagcatttattttatgccaggaactacttaaagtgctccagattactaactcatttaattctcacaaccatatgaaggaaggttactattattatctgcatttatgcacatgaaaactggtagagcaccttactcaggatcacagagtgacaaaaagacaagaaggtaaaattccatattaatatataaacatcaatttccaattctacataacaaacttattctgcgacccagacaacataatagactgatttatatacatatatatcagttggccacagttgcttcatttataaaatgaaggattgggcataatatctattataatgtctctttgcattctaatattggaaaacctctagagttacaagactctgaattccaacataatctgtactcatctgcctctgcttcctgccctcttctagatcaattctctgctaattgctgtcactcttccccaaagtttgcagagatggaaaaatctataggagactgacacttgaagcctttcattttcatgagttctgggtaaagcttagcaattctgacttataacctcacctaagttatcagggaactgggaaacaaagtgttttgtatgagtaaagtttctaagaagaaacagtttttccacaccggggcctgtcctggggtggggggaggggggagggatagcattaggagatatacctaatgaaaatgacaagttaatgggagcagcacaccaacatggcacatggatacaaatgtaacaaacctgtaggttgtgcacatgtaccttagaacttagagtataataataataataaaaaaataaaaaaaaataaagctgtgagcttcacccgcaaaaaaaagagaaagtttttccaagtatacaactgtatttgacataaatcttttttttttttttaaagcatatcatagttttccacattcttaaaaagacagcattaaataacatttaatcttttcctgatacttcagggccactattaagaaccattattttggccaggtgcggtggctcatgcctgtaatcccagcactttgggaggccaaggtaggtggatcatctgaggtcagcagttcgagaccagcctggccaacatggtgaaaccctgtctttactaaaaatacaaaaatacaaaattagccaggcgtggtggcgcacacctgtaatcccagttacttgggaagctgaggcagaagaattgcttgagcccaggaggcagaggttgcagtgagctgagattgtgccatggcactcaagcctgggagacagagcaagactctgtctcaaaacaaaaacaaaaaaaccccaccaatatttcttaatgttttctctttccatgctgagctgccagattaacttctcttactatagttttcctaactctatagagctttgttcaacagagtagccactagacatctgtggctatcaaacacctgaagcacagttagtccaaattgagatgtgctgtaagttaaataaacactagatttttactttatataaaaaaaaactcactgatattttatctgatcacatattgaatgataaatatatgtttaaagttcatttcacttgtttcattttactttttatttttgagatggggtctcactatgttgccaggctggtcttgaattcctaggctcaagcaatcctcctacctcagccccccaaagtctgggattacaggtgtgagccaatgcacccagcctctttttagtttttaaaatgcagctactagagaatttaaaatgacctatgtggttcacattctgtttctattggacagtgctgctctagtataccagattgctcttttactatgctgcttctagaatgatgtcaggtggagagcctgacaaccagtggaataagaataatgttacataagaaggagctctcttccacactgaattctttcttttccctttttttttttttttgagacagagtcttgctttgtcacccagcctggagtacagtggcgctatcttggctcattgcaacctccgcctcccaggttcaagcgattctcttgcctcagcctcctgagtaactaggatcacaggcatgtgcctctacgtctcgcaaatttttttgtatttttagtagagacagggtttcaccatgttggccagcctagtcttaaactcctgaccccaggtgatccgcccacctcagcctcccaaagtgctgagattacaggcacgagccaccgtgcctggcctccacactgtttctaactggaaacaaacaaacaaaaaaacaagagggagctcctctctagatattattaacctttcaagttcattaaaatgtggttttatttatatagtaagtctttaaagcttcattagtgaatgaatagtcaaacagcacagaagattcttaaacctcaactgctagattccatttgaattttaaatcccatgatctactgactttagagctttttaaaatcaaagttccaatgctgactcaatgtatagccttagacaagttacccatgttcttttcctctacttctagactttacaaatgatattaatattgactacatttgacttccaaatatggttattatatgggacattttggatttaagtaaaatactggtacctagtttctcaatcagatgacaatagtcaatacgttcttgaggattcagagatgataactgaaatatgtactgtttttttaattcttcatgagtctcctctatcgttataatctggaatgaaagttttactttagaaaaaattaacattaaaaatgatcagatacacagttcttttatagtggtattttactcagtcttctaagttatgaaatatacaaataatgatacaatgcaaaaaatagttttcaacatttgatgaagccttgatattgacatcaacaaatttctaatacagcctaacagcagtatgcaaaagctgtatcaccatattaaggatcaacaaaccttttctctagggtgcggagccacaggggggttggcgagtggaaaggcaatactgggggcttgaggcgtagggatcaggtggctgtcttttatgggagtttccagttcttcagagattgggtgtttgggagcttcagtcacacgtatgtttccaggatcacagacagctgaggacaataaaatgctgcagtgtgacaggatccaaataagactaaaaacaaattctaggaaatattctcatctgtcttagtcaagatgaagtcaagcacaaactctggaatgtaaaaagtacaggcaaaaaagtatcctatccccagaacttataaataaatgcatcccatctgcatgtgacaataataacaataaagaaaaaatgcaatttattagcattaaacagagcaagtgtgttatctgtgggcttctcccaacattttccttaaataccaagttttcattgttaagtgtaacccaaatttgtaacatgagagcaattctacacttggagaaaagcagaagcagagataaatctatatatctaatgggaggtcatcatgcaatgtgaaaaagaagaaaaggaagaaaaaagatgagagataggaaaattttgtttttaaggtaaagctcaaggaagaaaaaaaataggagaattcagaaagaaactcatacaatccaaagaacaaatgtaggtatgtgctaggcagaattcaaaagacttaaatgaaaataagatgataggaagaaaaaccaagcattaactccacaaacacaaaaagggttagctagaataaaagaacaatggtagacaccatgtctagaaaaaaacgcccaattctaaatttccaaatttatgaaaatgtttttcaatttactgatgaagtacctcaatttacaaattatttttctggctcaagtttaaaccaaaaccagaaatatctacgaagttttttttgtttgcacattcagatcagagaactacaacatgctcatctgtttatttttaagaggtcaacatgtacttaatacaaacaaatgcaaagatttctttcttgttaccctgtttagcaatttctgaatcatgtaaaggcttttgaaaaggagaatcctccaagttttgaatgtcaacctgaagctcagagtattgtgtgggacaactaggccactgcaaattgctggcaagccttgctctctcctcccttgctgtagggtcatcccaaatgatctgttcattttgggaaggctctgtgttgacatcaggtactgtctgacgagactgcctaaggaatagaagtgacagtttaaataaacagcaataacaaatccaaactcattaaatccataagttagaccataaaagttgtggctcacctttatatgcccaccatctagcacacagtatgcattaaaaatattaaataaatgaacctagggacattttttttttttaaaaaggtttaaggtttcttccagaaaagttatctgttttagctaggaacacatattttgactacatgtctacagaactaaaacttcaaaggagaaattcaacagtgtcaagaaattttttaaaaatactaaagtaattggtacatttaaaaatgtgattttccttaattatacaggttagggaaacagggtaatgtttcaaacactatggttactttacttaacagtagttatattttttaattacttgaaattataagcactatgattacatgggaggcttgctgtaaaggctgccttatcagaagggccttttggctattggtaaccactttccagagtctacggtggaacagcaatatgctgaattacagggaagtgcattttatggtgcgattgtaatgattccacgtgacagtaaatagaagtcctataattttctttatattcactcattcattcattcttagtaaaaataatttaccataaaacttacactgtggagaagcaaaaaaaaaaaaaacaaaaaacaaaaaacaaaacaaaacaccaaaacccataaaacaatttaccaaaggaacccccaaatagttcctttgcttcaaaaataaagaatatagccttttattctcacactatatttatttactctgatttggtacaggatttaggttctctataatgataaaacatgatctgaagcatattaaaaagctactttactcagtactgagataatgaactgcctcatgtaatacagttagcgtaagataaatgctagtttatcttatacttaattcaattagtcaactgaaaatacaagtcccataattcttatcacacaattatagatttttttcttctatcacgaaaaagatgaagttatgcaactgagcttaagtcacatcacactagaaactgtaatcaccttttctagaagataaattttacaaggagaatacaaaatgcatgcaaaatcccaacaaaaataactttaagattttacatattgcattagaaaaagactctgaaaaaatatatatgtacttattgtttaatacaaatactattgaatactaatactaaagagcagagagaactgcctactgaatccatttcaaatgaggcaaattagatcttaaaatcatttctttctcaacggaggtaataaaaagtatcaatcatgcctcactgtgaagcaggtgctgctgtaagacaaatctccatgtctgctccacctccgagtaagaaatctagaactgctgggagcaagaaatggaaggacaagctagaacgaaaaatctagtcagcagagagccaaaagcaatagataatactggaatataatatttactgtttgggctaaataaggcctaggcatataaccccttcactagtcttgatatttaaatttcagcttttactgcatattggggaaaaaaagaaaaaaaagctaaattaggccaagctcatggaattgagtcagcagcaggtacgtaaatcctttctctcaagtcatctagtctttctgccatcagtgacaggtacacacctcagtgcctctaggactctacttcgtccactgcgagcagagcgagtgctgtcaggggttgaagatgcgctgttacaaccacttcttgaaagggaagtcctctgcccttggggtttcactattgatgttgcagacattatctcctgtaactgcttctgaaagttctctctcatctctaaggtctgtgtcagaacttgaaacaaacacaaatacaccattcaaggtaagttcctcttttttaccatatcttacattaactattttgtttagacctggttgaacacaaacttattgacttgacatttactgaatattaactacaggctatagtaatgtactaaaactatgaatactgcagaacataaaaagcagcccttaccacaagcactgtatatgaaataactaggaagcccttcaaatacttttttttttttttttttggtgatagtctagcactgtcgcccaggctggacagtggtgcgacctcggctcactgcaacctccacctcccaggttcaagcaattctccctgcctcagcctctcaagtagctgggattacaggtgcccatcaccatgccgggctaatttttgtattttttagtagagacgcggtttcgccacgttggctaggctggtcttgaactcctgacctcaggtgatctgcccacctcagcctcccaaagtgctaggattacaggcatgagccaccgtgcctggcccccttcaaagacatttcatcaagacctgtagtgattatccctctgtaaagctccctgcctgcttctgactctcatggtatgtactacactctgagatgtcttatagtcatttgtgtatgtgtctgatttttcccaaagattcttttaattttttagagacagagtcttgctctgtggcccaggctggactgcagtggtatggtcatagctcattataacctctaactcctgggctcaagtgatcctccagcctcagcaacctgagtagctggcactacaggtgtacattaccacgcccagctaattttttaaattttttgtagagacaaggtctcactatgttgcccaggctgatctggaacccctagcatcaagcaatcctcttgcctttgcctcccaaagctctgagattacaggtgtgagccaccgtgcccagactccccaaaggctcttgaaaacacagaccacaacatacatccagccctccacatccaccggttctgcatgcatggattcaaccaagtatggatcagaaatattttaaagacataaaaatgaaaaatatcacaattaaaagtaccagtaaaaaaaataaaatataactatttacaaaacatttacagtgcattaggtattataagtaatccagagatgatttaaagtatacaggaggatgtgcattggttaaattcaaatcctatgtcattttatacataaggaacttaagcatctgtggattttggtacctgaggtaagtcctcggaaccactgccacatggataccaagggacaagacaactgtatttacctttggttttctttaaagcctaaactctggagtaagtattaaataaatgcatttggaatgaacagagtgagactaaccaaataggtaagtcatagggaaagctttggtaggttagaatgagtaaggaaaacagaacatattaaatctattaaaagacatccatgtataaggttattcactgcagtactatttataaaagcaagaaagtagaaataacctaaatgcctattaagaatggatgcctaaacaaagtgggaccattcataatgaatacaatacagttgcccaaaaagaaagaaaagggaagaaagaaggaaagggaaaggaagggaagagggaaaggagaggaagggggacaggaaggaaagggagggaaggaaggaagaaaagcaagaaagaaaaagactaaagaagctcctagttatctactgatataaaacactacccaaggtaacaaaaagatcagcgtatgaaatagcatgtatagtagtccaccatttatgtttttttttttttttttttttgagacaagagttttgctcttcttgcccaggctggagtgcaatggcatgatctcggctcaccgcaacctccgcctcccgagttcaagcgattctcctgcctcagcctcccgagtagctggaattacaggcatgcaaccaccatgcccggctaattttttgtatttttagtagagacggagtttctctatgttggccaggctgatctcaaactcctgaccttgggtgatctgcctgcctcagcctcccaaagtgctgggattacagacacgagccaccatgcccagcctatgtgtttgtttgtttttttttaatgggggaaaaacatatttacggctatatatgcataaagcagctctagaaggatacataaggaactaataacactggggggctggagaataagggtggaagaaactcttcatatgtctttttgtatctttaaaaccatgtggatatgttaaaatatattgtacatataagaaaactttttgaaaatcactcaaaagaactggaccaaagactagatttttaaaaaatcaccaacttcacctacctttaatggaatagggctgtatcacactaactccataaaaacctagtttcataaatttcataagctttacacttaaactacataaaactttgcaaattatcacttaatgatcagcatgggaccacaaatcaatcctctaatatatgctttgcttgtatttagtaatttaaacatattttacagctgggtgcagtggctcacaaggcaggaggatcctttcagcccaggagtttcagaccagtgtgggcaagatgacaagaccccatctccacaaaaaattgagaccttgtctcaaaaaaaatttttttaattaaaaaataaaatattttacctcctttagagtcattctttccacttccatttgatggtgctgactctttattattggtggccatattgtctacatcattttcttctaaaatcaaaggatctggctattgaaaaagaaaaattataaattctcaaaccaagccactgtataaggtttcatagcaatatatgattatacctttagcttaagagggggtaaatgtatcatccatatctcctacctcatcatcctttgttgaagacacagctgagagtagtcgactattacagagccggccatcttgcactgcgctgatatccaagctcattttgggattataagtatgtggataaagagattcaggaagatgtttacactcttgggcacactgcaatacaatggtgtgctttaagacaggactgacaaaatcttaatgaatagatgatgttaagtaggataaggacaagcaatacattatactgtaatatggcaaaaagttcacaaaactggtttgaaaagtagtttacactgaaaaatttgcatcatacaaatgacagattgtcctcatgttttaaatgtcatatccactgaagtataaaatctgaaaccattcctgtgcttttgcaaaggtatcaattaccctccagagaatacccaggaaaaaaaagaaacacagatctaaactctattgatatgttaaattttccccaaataattataaactttccattcatatcacatttttaattagtacaaggaaatggagaattagaaagagtatccattaaagatttgttaagtatttaaggactaaagatgttaagtttttgatgccaaagatctgaaatgtgtacagttaaccaagactattaaactggcttctagttccattgagagtgaaaactcttgagttagtgctctgaaataatgtttgtatacattttcaattaacagagatgggggggaaaaaagcactgcttacatctaaaagccagtgctcggaaacaatgtgtactcctctttcttttacagatttatactcccgattagtgtcatttggccgcccttgatagatgaaatgagtcactgtttcatcaaaactccacctgaaataaccaatacaaaaaaacaaataaccaagagaaacatcctcattagtttaagatgattcttatttactgtgaacagaatattctgaccttcccaaaactttcggactagagtaaacaagaccattaaaatgacaggctcaagccaagtgatacatgcctatagtcccagctacccaggaggctgaggcaggaggacacttgaggccaggagtttgaggctgtagtgtgctatgatcacccctgtgaacagacactgcacttcagcccaggcaacacagcaagaccccgcctcaagaaaaaaacagttaaaaaaatgatgataggctctatctttttggacaaattttatgcatatatctgtaggtatataaatacagagagaggtttagaagaatatcctttaaaatattactttcttctttatgcttttctgaattgtttcaattttcttttataaagaatatcacttttacagtaaccataaaggtatttcaaattaataaattgcaaagcatccaacttgccctccagttgctggcagtcactattcattgtatgccccaaaacagactatatatattttacacatcattatctcatccattcctcacaacaatcctaacactggtattattacattaatcttaaagataaaagaactaagggacatggttcagtaccctgttcaaggatactcaatgagtaaatgatagagataactttgacttcaaaagccatgctcttaactattatattatgctatgatctcccaattcttcctattcaatattctctctttttttgagacagagtctcactctgtcacccaggctggaatgcagtggcacaatcttggttcactgcaatctccacctcccgggttcaagcaattctcctatctcagcctcctgagcagctgggattataggcgtacgccaccacacccagctaatttttgtatttctagtagagatgggttttcaccatattgggcagtggtctcgaactcctgacttcaagtgatccacccgccttgcgctcccaaagtgctgggattacacgcatgagccaccgtgcccggccgctattcaatattctcttgacctgggaaacatcaagtaaaaaccaaagggtaggtaaaaattatatttctaaatacaatcaccaaaataaacagaattttatccttagggacacttaatattttccattttctaagtaaggaatatctctgagctttttaaatagacaaatgaattaagaagctgggtgcagtggcagtggctcatgcctgtaattccagtactttgggaggccaaggcaggtggatcacctgaggtcgggagtttcagaccagtcgaccaacatggagaaaccacatctcttctaaaaatacaaaattagccgggtgtggtggcgcatgcctgtaataccagctactcaggaggctgaggcaggagaatcgcttaaacccaggaggtggaggttgtggtgagtcgagattatgtcactgcactccagcctgggcaacaagagcaaaactccctctcaaaaaaaaaaaagaattaagaaaaagaagtaagaagtactattgcctcctaagttatattataaaaatctctatttcctactgaccatgtatcctaaaacataacaataaaaatacaccttgcctaatttgttagttctcagaataactgtctccctttctgcgtagtggtatattatcaagataattcagaaaaacagaggagtatttttgcctgaatcaatttggtttaccagtcaactccactatgacaatatggaaaccatgagtttcagtcttcagaggccattcaagaacagactgtcagtggttgtagatggtttacatcagggtttggcaaattttttcttaaaaggccagatagtaaatattttagactttgcaggccaaacaatctcttttgcaactgctcaacttttgtcttgtatgtgaaagcagtcataggcaatttgtaagtgaaaaggcattgctgtattccaataaaactttacttacaaaaacagatgaaccagcccatacacccttggtctagatcagcggtttcagcaaaagtgttacttcaggggttattttggacatttgtgagggtgattttggttgttacaatgtgtgtttgtatgttggagggtgctactagcatgcagtgggtaaggtacaggatgctggaaattctggggaacagtcatacatataattatgtcatatcttgcatgatattctaatgtcccgacaaattcacgtatgtaaaaaaaagttgtttataattagttgagtctagaacctgttcgacatataaacaagttatttttttgcagttttaatatacactaatattacaaaaatgtgactactgtataaattgatggaagaccactgctactcatggtatctgagtccccagatcggtctcagccttgggactgttggatttgtggtgcctttacataggtatacaaacgtattaatactccattgttttctagtgtagtcagccttaggcattatacataactgaacatatatcttttctatattatgcaccttctatttctcctatgcatcacagagtgctatactgtctgctacttttttaaattataaaagtaggtaggttatatttatattcattttaatagagggaatgttacacaaatatttgtaataaaatgaagatgctgcatctgatttgttgcaaagatcgggcctacatgtttaactgtctgaagacagaagacagtatccgatgatctctttgggacagtctggtcctagatgatggaagggaacatttggaacaacttcacttgagaactgctttactctatgcatatataaatatctaacctctgcatattataaggctcttccctttatcaattaccaatccatttcaggaaaagatttaatataaactttaatgcaatgcaatggttaaattctgtttaggaatttcagtaataaattctattttttatactgagaggactggcatttaaaatcatataaaaacatacatcctatatgttcccttgaaagtcttatatcatgtctacatcaaaacagaataaacaaggaaacattcaattttgaggaaaaaaaaatatacacacaccccttgtagggctactatgagaatgaaacgagataatgctcagcaactggcaataggtaacataataggtaattagataataacagataagattacctaacaatttataataggtaatacaaatataccgtagaagagcttcactatttcaaatggatgtaccaaacactaagatgcttatatgtattacagatcaattttactcctatattttcctgtcctaatttctttatcaaatagaaaacaaactgaaataagagttaccaaaggggaagatgaaactaatcatattcctgcaatggttcatcatttgttaaacaaattcttatgatatctatgaatggctgaacacaagttatcaacaaagcaagcattacagctagtggaggagtacagtcaactcaggactggctgaaataggtaagagattctcaattctggatactgatgccatttgtgctagagatctgttttcagcttaggctgtcaggttgactgaagaaaaatctgacaatctaagtctccaaagtttaaaaaaaaaaaaagataatgaaaacatgctcaaaaaagactatcttaataaaggagggctgccagagtacttagtactactcccagagggctctaatctgaaaaatcactagtaaaaataaacttaatctcagatccagatgtattactattaatagactctaaactccttgaacacagggattcttttagactatactgatccttcatggatcccaggtttctagaatagttagtggcataaaataggctctccaatatttgttgtgcataccctaaaaaatatacattatatacatataagagtgaattgatatgtgagaggctattttcaacagatgtggtaaattaaaaatcaactggagagattttgtagataaagatgcatgaaacaaaataaatgtattcttgtagatgctcacaatagctttaggtttccttataaatttcagtcatatcaccatgaaacagaaagatgtgccaactacctgtaatctgctcctagagaggctgcgatcccatttagttcactctgcttcttactgagttttttactaacacataccactactttgtgaagtggctttggggcttcttcctgtccatggaaaataaaagaaacagatcagtcattattgtttgaaatgttatctaaaacttccttttaataagagaactaatcctaccttctctgactgggcctctttcagttgagggctggcagaaagagcgacagcatttcgagagctatttgccaaagcaagttgcaagtttttgacaataacttctgagagtggcgtactcggtttccttttctgttggctgggacgtcctggagtttccaaggctgcaagtgcatcctatacatatgaaggagagagagagatggagaaaagaagagagagagagagaagcaagatgggttaataggacaggaaaaagaaagaggaggagagaggggtaaagagagagaagggggagaatcctcaaaattaatggattacagtttaacttcctctagttttcctccaaataacaagaaaaagaataaactataatcaaatccatatactgtgaacaaaaattccatactgtccagcaaattggttcaaagagactaactagcttacattttcagcagtgcttgtctcttacctgaatcttagagttgaatttgaaaacaaaacaaaccaaaaaaacccagaaggaaacaaataagcaacgacggatataatcaagaaatggattataaggaaggttagaaagtcaaaatgagctgagaattaaaaaaaaaaaaatcttcaaaagttcaaaatatattcctgttctaaagccaccaacagttccctcctgaaaggaagctactgttgtccaaatggcttgctcattctcttttgcatgtgtatagtattccatgtatgtatcagaatgtatttaacctgtgtacaactgataagctttcggttaacagtcttttgcaagtataatgatgcaatgaataaccttgtacacaaaccattttgcacacacaagagtaaaggaaaccttttaagcaaaatgtatctaccagcccagtgcagtggctcctgtcagtaatctcagctactccagagaagttgaagcaagaagacagctcaagaccaggagttttgagacgagtctgggaaacacagttagacccaatttctttttaaaaaaactaaaaaaacaagaccaacatgtatctaccaatgttgacattttcatgagcaaagtatgagtgtgtgtgttttccaaacgtgcttgatatcacagtaatcagatttttcttttttgacaatctgataagactaaaaaattttatctgtatgctttaattttctactcttttatactgaatgaggttaaatatctttatatgtgtgtgtgtgtgtatatatatatatatttttgagacggagtctcgctctgtcacccaggctggagtacaatggcgcgatctcggctcactgcaacctctgcctcctgggttcaagcgattctcctgcctcagcctcccgagtagctgggactacaggcatgcaccaccatgcctggctaatttttcgtatttttagtagagacagggtttcaccatgttgctcaagctgatctcaaactcctgacctcatcatccaaccgcctttgactcccaaagtgctgggataacaggcgtgagccaccgcgcctggctatatgtatatttatatctaattttttgtgataactatctgctcctatcctttgcccatttttctactgggttgttagtcttttttttaatatattcgcttgtatgaatatacttttatattcatttgtatgaatttatatgtgcatgtatcaactgtgatataatacccacgtatttattttcaatttatcatttgtcaaatttttgccatggagctttttttttttttcagagatggagtcctgctttgtcacccaagctggagtacagtggcatgattataggtcactgtaacttctaactcctggattcaaggatcctctcacctcagcctcccaggtagctgggactccagatgcacaaccctgtgctcagctaattttaaaatttttcatagagacagggtcttgccgtctttcccaggctggtctcaaactcctaggctcaagcaatcctctcgccttggcctcccaaagtgctgggattacaggtgtgagtcacggtgactcgctgtaatttttttgttttttgagacggggtcttgctctcttgcccagaacggactgaagtggctcaatcttagttcactgcaacctctgcctccagggctcaagcaatcctcccttgtcagctgggactataggtatgtgccatcacacccagttagagaatttttaatgctgtcaaattcatacgaatcttctatttcttttggagtgtatgttatagttaggccttccccacactaggattattttagaaacaaattcatgacatgtttgggaatttttatggcttcatttcttatgtttaaatctgatcatctaggctgggtgtggttgttcacgcttgtaattccaacactttgggaggccaaggcagaactgcctgagcccaggagttctagaccagcctgagcaacatggtgagactctacctctccaaaaaatacaattagctgggcacagtgtcatgtacctctagtctgagttactccagaggctgaggtgggaggactgcttgagcccaggaggtcaaagctgcagtgagccacgatgatgccactgaactccagcctaagtgataaagtgagatcctatttcaagaaaaaccccaaaagttgatcatctaaaaagtattctgatgtaaagtgtgagctttaattacaaacgtattttcagatggctacctaattgtccaatttgaatgccacctttattacataataaattcccctatttgtggagtataatcttatacactaacttgattattcacgtgacaccacactgttttaactactgcaactttataggaggttttaataaacggtagggctactgcctacctgcaattatacttttcagattttttttaatattgtttctgcttgcatttttttctaggacctacattaccttttgatatggtttggatttgtgtccccactcaaatctcatgttgaactgtaatccccaatgatggaggaggagcctggtggcagttgactggattatgggggcggatttcccccttgctgttcttgtgataatgagtgagttctcatgatatctggtttgagatggagtctcactctgttgcccgggctgtggcgcgaccttggtgcaatgcaatctctgcctcctggttcaagtgattctcttgcctcagtctctcgagtagctgggattacaggcatatgccatcacacccggctcatttttatatttttagtagagatggggtttcgccatattggccaggctggtcttgaactcctgacctcaggtgatccacccaccttggcctcccaaagtgctgggattacaggcgtgagccactgcgcctggctgatatccagttgtttaaaagtgtgtggcatctccccccgctatcttttcctccttctccagccatgaaagacgtgctcacttccccttcattttcgaccgtgattgtaattttcctgaggcctccccagtggtgcttcctgtacagcctgtggaactgagtcaattaaacctcttttctttataaagttggacgtggtggctcgcgcctgtaatcccagcattttgggaggctgaggtgggtggatcacttgaggtcaggagtttgagaccagcctgcccaacacagtgaaaccccgtctctactgaaaatacaaaaattagccgggtgtgggggtaggcgcctgtaatcccagttacttgggaagctgaggcagcagaattgcttgaacccaggaggcggaggttgcagtgagccgagatcatgccaccgcacttcagcctgggtgacaagagcaagactccatctcaaaataaaaaaataaaaataagaataaattactcggtctggggtagttctttatagcaatgtgcaaacagattaatacacctttatagatcttgacaatgtttaaatctattttgcaagaacatggtaagtctttctatatgctaaactttttaaaatttcttcaaagcattttagaggattccttatataaaaatcagaagctcccataccacatctatctgccttcagcacacgtgccactagtaccttcctctacttaagaagtagatcccaatgcctctcagactcaagcctcctgcaagtcttccttctctcatctgcatcatcaattggctctctaatggcagttacactggcatatagttatttcttcttctttttttgagacagggtctcagtttgtcacccaggctggagtacagcggcatgatcactgcccactgcgtcctctatctcctggactcaagcaatcctcctgcctccgcctaccaactagctggggctacagacgtgcaccaccacacccagctaatttttgtgtattttgtagagacagggtcttgccatgttgcccagatttgtcttgaaatcctggactcaagtgatcctcccgtcttgggctcccaaagtgctgggattatgggcatgcaccactgagcctggctatttcttccaccttaaaaagaaaacaaccttcttttgaccctactttgccccataactacaactccatttcttggctcccctttatggcaagattccttcaaaaatcgttgtttacactcaatgtctccgattcttctcatttctttatgaacccacaccagcttccacctccatcatgccaccaaaacccttattgttatgatgacgccattgaccttcataatgctcaatccactggccaattttctattctcacctttctttatcttagagcagtcctggacatagttaacccctcctccctctttgaaatacttggctctttgaaataagctctaggctttcctcttctcttatagctccttctcagtctcctttgctggttcctcctctaaaggtgagcacctcaaggtgttgcttagagctcttttctttggctggacgtggtggctcacacctataaccccaacactttgggaggccaaggcaggaggattgctcaagtccaggaatttaaggccagtctgagcaatgtggtaagatccccgtatctacaaaaaaattaaaaattagccaggtgtggtgacatgcacctgaagtcctagttgctttgaaggcagaggtggaagtattgcttgagtccagaggtcaaggctataatgggctgtgatcatgccactacactccagcctggacgacacagcgagaccttgtcttaaacacaacaaaacaaaacaaaacctttttcctttctttgccttctcctactctcttggcatctattctcacatggctttacacattacctacaaactcagaaccccaaatttttatctccagcccaaaccattcctcaaacttccagcgttatttgcaactgcctatttaacaactacttggatatctaataggcatctcaaacttaatgtgtctaacatgtgaactctagatctttaggctccaatcccaacctgttctgttcaactcagtttggactggcaactccattcttctcatctctcagaccaaaaatttgaaaagaatcaaattttaaaacctaccatgtattgtggaaaactgatttcaaatgattgagaattcttaacatctagacatcctcgtgaaactatttgagttcaaagataaaagaaaaggccaggtgttgtggctcatgcctgtaatcccagcactttcagaggccaaggcaggcagatcacttgatatcaggagttcaaggtcagcctggccaacatggcaaaaccccatctctactaaaaatacaaaaattagccgggcatggtggcgcatgcctgtaatcccagctactcgggaggctgaggcaggagaatcgcttgaacctaggaggcagaggttgcagtgagctgagattgtgccactgcactctagcctgggtcctgggtgacagagcgagactctgtcttaaaaaaaaaagataaaagataaaagaaaaatccacatgacctccaggcaaaaagatgaaataacttccaaagacaagtaatttaattagattggcatcagattttttttcaaaaacaacacatacaaagcaaggcagtagtggaagagcattttcaggaaactcaagaaaaaaaactgcaagctaagaatagtacatccaaacaatttgtagaagaagcaaggccacagtaaaagttatgaacatgcagaactcaaggaatactgtacacgtgtgtacacacagattcctgaggaacctactagaaaatgaacttcatcctaccaaaagtgacaggtaagcttcaaaaagaagagtacacatttcatatattcgattgtagagttaagaccaaaacgagggtggggtctgtgggttgaaaaaatatattttccctcctgacaaagtaaaaaaatatgcaatgaaaaatagaagagagaaaagggggaaagagaataagatcttctatacaggcaattagtgggagtcaaaaatataatttaaaactgacaaataataaagaatactatttaagtaagaagaggtatgcatcatcatgcccagctaatttttccaactttttgtagatgtggggtctcaccatgttgcccaggctggtgtccaactccttgcctcaagtgatccacctcagcctcaatgtgctgggataacaggcatgagccactatgtccagccatccttgtacttatttctttttgagacagggtcttgctctgtcactcaggctggagtgcagtggtaggatgatagctcactgcagcctcaaactcctgggctcaagccatcttgctgcctcaccctcctgagttctaggactataggtgcactccaccaagcccagctaattaaaaaaaaaatttgttagagatggcggtctcgctatattgcctagactggtccagaactcctggtctcaagtgaggctcccacctcagcctcccaaaatgctgggattacaggtgtgagccaccacgcccagccccttgtaccacttttattttgcaactttttgtaagttagaaattattttgaagtaaaaagtgaaataaaacaacttataatagcaagtatcagcaaagatgaggaacactgggtacactcaacacactactggtggaagcatgaactggtataatcactttggcaaaaaatttgtcattctctactgaagctgaaatataacccaacaatttcacttccaggtatataccacatagtaacacacacacatagactccaagagacacgcacaagaatgttcacagtaaaattattttgtaagggcaaaaaactagtaaccaactaaatgcccatcaacagtacactggaaatgtaaattctgtatatccatacaaaggaataaataaatgaactatatttgcatgcagcaaaacagacaaatctaaataagggttaaagaacaataaaaaaaaaacagactcaaaagaatacatactatgattccacatatttaaaagtcaaaaacaagcataacaaaactatagttattagaagtcaggagtatactttagggaggaagcagcgatggagccacaaggaagggtttacagtactgaccatggtctctatctgaacgtgtatagtggcttctcaatgattaaccctgatagttcattagcagtatatttattgtactgctctgatgtatattaattaaaaattaagtttaaataagtggtgagtttttttgaggggggcaagggtgaggcctaatagatggtcaattttgtgattattccatgggccctttcatgttttaagtaaagaattcaacataccatattatatcagtttgaagatgataagattatcatctgattataagattatagatgaagcattataatgcttataagattataagatgaagcattatttatgtgccatcaaaaaagaaagaaaaaagaggaaaaacactgctcaataaactatgactctaaacaataaaatctttaatgtgttttttgtattgaggctattcagaactatcagctttccactgcaaaacttttattgcaatgtatctatataagaatggtctcaatgactgaaaatatctctactattttcttgcccaccaatattattacatttgctcttcagagagtctgtgagctatgacactttagagatcatctggattttatagatgagaataatgaagccgaaagaggttgacttgcttttaaaaggcagtaggaggcaaagaagaggcttgatcctacacctcacagttctcaagactgattttcctctatgtcttaagggatatggacctgagtattaatcacagtacaaaatgttacctcagaagagatttcatgtgaaaacttagaattttgagtttaatagtaaagacacactttttttaatgtgcgtcactggaattctgaccaaaaataaaggcataaattagcttggggaaaactgtcctggatatcaattaatatttattttctgaatatgaataatctataaactttttagtaagtccactccaaaacacaataaaaattattaaaatattgcttctaaataccctacaagcaaaaatatcaacacgtgaatgagtaaaataattcttcaaaggttcgtggataaagaaatcatagacagtgggtttgaacagccacttaagaggtcaaaagctactaaagaaataatgatgaaaatcagttttggaaaatcaaagaaaattatttggaagattacattagcccctgatttacaaatgcatttttcagaaagggagccatactacaatgctcacgagatcaaactaaaacacagacttaactcatgtctttacaggaaacaattcaagtaaggtgatatacacacattttcagaaggcaaatcccgggtgtactctgagaaccaatatataaagtatcagtgtgtttacattttatagtttataaagtgatttcatcatttgatctttataatctatgaattttcagagcaaatattatcttctttgtatgaaaaaacaaactgaagctcagatatgttaaatgattggcctagtcatacagttcaagatcgatccagtacttgaacccagatgtcctaatttcacaccatatttatctatagctgttaccttaaccctaaatgtatgctgggactcaaaacgttcaaactcagtaacataaatctacttgccaatgtctctggaaaatttattactacacttcagaggtgatgccaaatttggtgctttaactttataaacggtaaaactgttaactctgggaccactgcctataaaccttaccttcacatcaaaggaaggcttgaagagtttgtccttggacaggaattttgatggtgtatccaggtgtaacgagggctccttctgaagtggttgtcctactgctggggaggctgcgacctgtctggcatgttgtgagaccacagcacggaaagctttactctgaaagcggttcatatctaaaggtgtaacgacggtttttctgtgagtttgcaggcgtgtgccaggatgctctgcagtatctgaatttagattgattccatttgttatttctgtttccaaacttcgttctagagatttaaaatgaaaagaaacaaatatgagccactaatgcccactttttcccggtacacaagaagtaatattttatactgttttctttcctttctttcttgcataactcctgggctcaagagatccatctacctcggcatcctaatctgttagttttcatgtcaattctcaggtacactttaaatcacaaaattatatacctactttccaagaaacaaaccagattatgcattaaatatatgttgagttagacaagcacattaactgaaaaaataataatagatttcctgtttcatcttgctatgtctcaataagcctatttgccaaaaattgttatcagtgaatgtctttctagtcaatgacagagtaaaaagaaaaatctcaattacaggtactcagagttaactacagtctagttttggaaagtccttaatcaaattttaatatgacctgaacatcacttagcctcagtcataaaattaccagtctgtctggcaaaataagtaatgactctgagaggtattcccaagctgctgatatgtccctgaagtttgcccatggatgctattatcttacaagagagggtactgtattcttccacctatgccttccaccttttttcaacatttaacaaaaaaccttattagatagctactccatgccaggcctagtgttagacatgggaaatacagaattcacaagacatgcatgttcactgcctttctggaactttaaatttagcaggaagacacaaaataaacaaccattataacactgaggtaagagataaaagggatgatacagagtgtcatggtgaaacaaaaaacattataccaagacaaaggccatccttggtgagtcaagaatgcttcccaagacagtgtggcgattcctcaaagatctagaactagaaataccatttgacccagcgatcccattactgggtatatacccaaaggattacaaatcatgctactataaagacacatgtacacatatgtttattgcagcactattcacaatagcaaagacttggaaccaacccaaatgtctatcaatgatagactggattaagaaaatgtggcacatatacaccatggaatactatgcagccagaaaaaaggatgaattcatgtcctttgtcgggacatggatgaagctggaaaccatcattctgaggaaactatcacaaggacagaaaaccaaacaccgcatgttctcactcatagatgggaattgaacagacacagggcagggaacatcacacaccggggcctgtcgtaggatggggggatgggggagggatagtattaggagaaatacctaatgtaaatgacgaattaatgggtgcagcaaaccaacatgacacatgtatacatatgtaacaaacccgcatattgtgcacatgtaccccagaacttaaagtgtaataataattaaaaagaaaaaatgaaaggcttcccagggaaagtggtatcttagctgagaactgaaagataagcaggaagagcaggcaactgtgaggtggtctacaggaaacatgcagaagcccaaagataagaggagagatagcatgttaattatatagtgtgttactatgagccatagaaagaatcaacagtaaataggagccaagcttacatctgtagacttcgaacactgagaccctcactgcacccaatgtgaaaagcaaaaatcaatgacccttcctaaacacaagcattggcacatttatatcccagaaaccatctagttgtaaatatatataaaagaacagaataaaagtattaaccttctttagttgaattttcaatcagaaaatggctttcgtctgctctctttcccgttctagcagtctccaacagccaagctatagtaacggcaggtaaattccacttctttgcagcttcatatttagagccaccacgttctttcagtataagatgagtactggcaaacatgcctttctttgcattggatttgcgaacaaagtattcttgaacactgaaatttatgtttaaagaagtggaaatggtcacatatacaattaacccgcaaaactaacaaaatttccaacacaacagtgtggttagagatcatgtaagtataaaaaaaaatactgattaaaagttggtttactctatctgaaattaagctaatccccttacaaatgcttactctagggtaaaaatgtattgctgtaacaaactttttataaaaacataattagacatgcaaagaacagacagcaaaaatccttttgagacagggtcttgctatgttgtccagactggagtgcagtggcacaatcacagctcactgcaacctccgcctcccaggctcaagccatcctcccacctcagcctccccagtacctaagactacaggtgtacaccaccacacctggctaatttttgtattttttgtagagatggggtttcacaatgttgcctagcctggtctcgaactcctgagctcaagtgatcctcctgcctcagcctcctaaagttgggattacaggcgtgaaccacctcacacagccaaaattacctccttaattagttatcacccccacaccttgtcctttcctcccaaaagaaggcacagaaaaaatgacaggagcaaagtgtataaataacattattattattttttaacctactacaactttccaaagcatttctacatattatctcatttgatcctctcaatatttaagtatagacatgggaaaaaatacagagaaattaagtgcctcaagatcataggatattaaacacagagaatacggggcagaaaaagaagtctacgacttgagattgaacagaattccgtgatttcttttatgacttctgggttttatgttctagttcccaacttttcagatttttaaatttcccatgtttcctagcactttttttttctatgttttgtgtttatcttagtacttttataatttcattttttacatttaacccaccaatccattcagtacttatttagatatgagatactgctccaactttaatgaatcctatttattgaataagccatgtcttccttatatatatttgaaatgtcacttgtatcgtaaattcctttttacatttgggtctcctgctacatttgctgtccattaattaaactttctgctacacgtaaccacactgttatttagtgaagtttcacaaaatatatatttgtttgtttgttttctgagacagggtcttgctctgtcctccaggctagagtacagtggcgccactgtgactcactgcagccttgacctcccaggctcaaacaatcctcccacctcagcctcccaaataactgagactacagatttatgctacattgcctggctcatttttaaaattttttgtaaagacagggtctcagtatattgtccaggctggtgttgaacttggcctcctgccacggcctctcaaagtgctaggattacaggcatgaaccaccagacctggccacaaaatatattttaataactgttagggctagtcccaattattctatttcagaatttgcatgactttcctgctgagtacagctttagctgtatccagtggagtctgtcatcatgtatgttattatcttccacaatttcagttttaaaagaattttattatttcatataattcaaacagaaaacagcaaaaaaagaaatatacagctatacgaattattataaggtgaaacccttaagtccaccacccaggtcagaagacagaatcttgctaactaccccagaacctctccaacatgccatataaacccccttccctcccttcttaatagtagccactatttgggcttttttttggagacaggatctcattttgttgccctggctggagtatagttgtgtgatcatagctcactgcagccctggtctcctgggctcaagtaatcctcctgccttagcctcccgagtagctgggaccataggcacatgccaccatgcctggctcatttttttttattattttttaaatagagacgaggtctcactatgttgtacaggctggtcttgaactcctgagctcaagcaatcttttagcctcccgagtgctgggattacaggtgtgagccactgtgcttggcctatttggatacttatagtaatcacttctttacttttctataatcaaataatggcaactttaaagactacatttaggcttttgctttttcaagtcttttagcttataggttcctaccttcttttccatgcccttaatatatattcattgaagacactggatcatttatgccagagttgtactaaagtctgggtcttgctgattatatcactgtagtatagtttaacgtgttattctgctgtttgcatttcctataaattgggaattggatctagaagcatcatcagattgaggtttgattattttggcaagactacttcaaagtggtggtgtattctttgtaagaaggcacatcatgtcttgtccctttattgtgtgatcgactattgatgttcaatgcctagattctttcattcattaggggttacagtcttatcattccttatttatttatttgtttgttgaaacatctttataaagggaaactttgtcgtatccactatcatgttaccctgatgcaaactgcacaggaaatgcaaggtaattccttgatcctttccttttgtcagctttcaaagtaatggactggttctctagcatctttcaaagatgaccaattaccttactttatttggtgtcattatgaagtcacaacttaaacactatttcatgtgtttggacccactgcagttattacctctaatgatacctaagttttcatctttggacaacagaggcactttttttttttaaggctagtcaagtgaagcagtgggagtggagaaggaaccacataacactcataaatataataaagacacccaaccaaattctaatttgaatgctctccaagaagtcaaaataaataaaaagatacaccaatacaacaggtgcattaaaaatattacataccttgctccaaggaggtttgctaggaatgttaaagactctttttctgctccagcacactggctaaatgaaataacacaatcctctaaaggagtcattcctgtcattactggaactggtgtgaagagaggattcgactttggatcaaacaaagtctgatagtctatgcaagtaaccttttaaaaacaaaagaaatagtaaagccaacctgaaataagcaaccagtggttaacactggttcaggtacagaagcaataatttagttttgataagaagaaattttactttaatacaaacttgtgtatgctcattctcaatacatttcatatcataatgttagagtatatatatacatacacacatatacatacatcgactaattacattaggctattaaaatcggtaagatctattattagagttactgaatgttgctttaaatttcattccttctaatgtattagtttatactatttttctcataattcttggaatgttaaaaaaaaaaaaatcaacagtgaaattaccagtgatgctttggttatgagaaaacaagacaaatagtatgagatgaccctagagtgacctcctaagaaggaatgttgctgctgtggccctgggaaacagtaatctctactgtatcgggattaggccaagaagcttgcacatttaattttgaatttcccttgctaaaagcaaaatcaagagtgttcaagtccaagcattgatttactgtaactgaactgtctaagaaataaacattaaccttcttggcattcagatatccttcgatactttatttcaaccactagtgttgtcttaccagccatgtatttgtaacaacttctcccacagtggcttccacttcacaccccagcagaggaaccacagcataatccgcaacagttctgctcagaagggacatgattttcccagcattttcttttatgatgtttgcgatgttagattcattttcattactaaaacccaaaacaaggaaactcttttggctaaataagccttcttcagtaattgtagaaacatcagggacacaatgactgacagaagactggttttcttcttgcaaagaaatgtgagtagaatcattcaagggctcagcatgagtagaatcattaaagggcctggcttcagacgtcttagcctcaactgaaagagaaaagtaaatgttttctaaccaacaatttaccttatacagtttacttcctagcaaggatattaacgtaacatggaatctgataattttgaccatacttacaaaactaaagcttacgtgtataataaagggatatggattcaccccgtcttcggggttaccaagagtccttatcagtattaccatcatccattgggaaggacaagagcaatcatgttagttctaggtattcctagtataatggaaacttgaattagtttaaaattatatagctccaacaggacttagttccaaaactggtttagatgattcaccataaaattaagaaactatcattaagaaaaaaattaacaagtctaaatggtataactgtcaagtccttaacatggaacatgttaacatggaaataactataaggaagtggctggcaaatcctaaaatatttattgtctactcctttagagaaaaagtttgccctgctatgtgattccaacaaggctggaagctatccaagaatcactctttcatttatataagcactgtgactaagtgctttacaaatgcatgtaatgctcacataatgctaactgtgaggctgatactatcagtacatcccttttgtacaaaaggagtctcaggcttgaagaggttatgtaacttgcctaaggtcacacagttaagtggcagaaatgagatacaaaccaaagtctgtctaactccagagttcacaccaccatgttatagtgccatcttcgtacttctatcctcatctccaacagacactagcattttcatttttaagtaaattgtaatatacattaggaacttgtaaattaagtacactgcaatatatattaggaacttatgactcctactaaacataagtattaaaattgtacttattcgcactaaggaagcatagttttgtctagggagtttactggtcagtaagtcaggagagctgggttctagttttatagtctctttgacccttggtttcataatataaggaataaagggtaatagtatacttataatttacagatatactcatgggaatgaatatgcttagatggaattaaaggtgaggcaatactataaaacattccggaaagttttttaaacagttttgttaaaatgtaaagtttgttttataagtaaaaaccttcttattttttgcaagtacaattattttgcagtcacatctaggagaaaaaaataacttttttcgacgtctatatgttgttggtaagatgggaaggaggaagaaatccagtagaattttagactactactataaaaacaaagtagaaatactaagttcttataaaccatcagtaaaactctgaagttattaagagactcataataaactaacatgttctacagcagttctttccgtttattttagcagtaggatctcttttcaaacagaccgcacccaaaagcctaagagatactacataataaacctatcattcaaaaagctcccctagggccgggcgcggtggctcatgcctgtaatcccagcactttgggaggctgaggtgggtggatcacaaggtcaggagttcaagagcagcctggccaacatggagaaaccccatctctactaaaaatagaaaaattagctgggcatggtggcacgtgcctgtaatcccagctacttgggaggctgaggcaggagaatcacttgaacccagaaggcagaggttgcagtgagccaagaccacgccactgcactccagcctggtgacagagcaagactgcatctcaaaaaaaaaacaaaaaactcccttaaatcaaaagccattttaagaattaattataaaatactttattatagactttctaagatgcttggtgatccactaagatttaccatcacttaatccttataaagtcagtaaaccactagctgtcttaggaaggtttaagaaactaatcacctgccctacaccaagtacccttggctgaaggatagtatgtaaaattgctggctgggtgcagtggctcaagcctgtaatcccaacattctgggaggctaagacaggaggatcacatgaggccaggagtttgagaccaacctggccaacatggtgaaaccccatctctactaaaaatacaaaaattagctgggcgtggtggtgcacacctgtactcccaactactaaggaggctgagggaagagaattgcgtgaactcgggaggaggaggttgcagtgatccaagcttgtgacactacactccatcctcagtgatggagtgagaccctgtctccaaaaaaaaaaaaaaaaatcactttcagttataccacagcatcctggaaaatcaagatgatttcctgatgtgatacaatactaaagcataagtaaatggtttgagaaaagtcaattttgtagtacggaaatagtgtaaataaaaaaggaatgctaggaattccctctctagaaatatggtgggctaggatctttgaaacactctcactaaaaacacttcaaaatacaggataaaatattaaaatccagaccactaaagtggttactaaatccagaacattaagtagttactaaagctaatggttagtcaaaatctattaaatatctgtgcagtaacccagacccttggaatgtaaaggtatcacacaagagataggagccaatcctttggtttcataaaacttagaggtgaaggagagtataccctgagagaacaagcccagaacccatgaagagacatatctttagtaaacagaccaaaactaaccaaccaaccaacaacaaatctgccctgtaaaggaagaggtcaagaacactggctttgtgtcaaggggaaacaacatctctcctaagaatctgttcatcagaggctggtcctcaaagtaggtttgggtataaattcatatagctggaggtctaagaaacctccagccaatacaccaacttaaaggcatattgagtttgtaaactcctaggcacctagcagacccaaacatgaaccttttctggggtaacaaacccctaccccaagtttcttagaattcctagagtcctagtaagtacaagttcacaataaaaatcacaaaacacaagaaaaccaggcaccataaacaacagccaacagaacaattcacagatgttttgataggtttaatgtgttttaagaaataaagaacaaaaaatacaaatacaaaatgacagacttggctgggtgtggtggctcacacctgcaatcccagcactttgggaggctgaggtgcttcaagaccagcctgggtaacatagtagcaccccatctctatttttaaaagtaaaaaaataaatgacagactatttaaaaagctaaaacttctaggaattgaaaaattaattattaaaacagaaaatttaatggatgggtaaaacagattaggcaatagcggaagagatgattcgtgatctggaaaaaaatctgaaggaattacacataataaatcacagaaagacaaaaagatggaagataaggacaggttaagtgacctatatgcaaagcaaatgggagttaagagaatatagagaatgggggagaggcaatattcaaagagataataaacatttcttgacctaacaaaaagcaaaaaatctactaattctcagattcagaaggcacagtgaatctcaagcaggacaaataaatggtaaagctctaggacacaaaaaccaaaaggaagactatcttaaaaacagccagaggataaagacagattatctgtaaaggaatgacagactgatatctgacctcctatccagcagtcagggaaatagatgacaatgaaacaatatctctgtgcttaaagaaactgtctagaactgtatacccagccgaagagtcttagagaaactaaaggagtttctaaaggatattgttttaggaagaaagaaaatgattccaaaagagaggtctcagatgtaaaaagaactggggagagcaaagaaacagttaaacgtgttagtaaatgaaacaaatactgaccatataaaagcataataacgcctaattgtaagatgttaaaagataatgaaaatactagacaaaatcacataagctgagtatgttgatgagtggagagagggagcagggctagttgtgatcattaaagtattttaggctgggctcagtggctcacgcccgtaatcccagcactttgggaggccaaggcgggtggatcacctgaggtcgggagttcaagaccagcctggccaacactgagaaaccccatctctactaaaaatacaaaattagccaggggtggtggcgcatgcctgtaatcccagctacttgggaggctgaggcagaaagaatcacttgaacctgggaggcagaggttgcagtgagctgagatcatgccactacactccagcctgcgcaacaagagcgaaatcctgcttcaaaaaaaaaaaaagttttctaaggttcttgttttattcgaggtagattaaaattctgattaacttcagattttaagttatgatacacattaaatttacttaaatgtatatatttttggctatattaggtattttataaaggcttttttttaataaaaaagaagtaatgatgtttataatgcttcactggcaatttaccttactacatgataagagtacatactgaggtggtagtccacagtacagtttcatgcattaaagaccacaataatccagtaagaggtatttgttacaaggttttaataaaaggctcatgatattacaaactcacacacaaaccaagcaatgcctgtatatataacaaatcaaaatagagctagttagctggagacaggagagagggttaaagggttcaggaccctcttgtcttgcctgctcagaaaaaaagttatgaggaaaattttaaggaaagaaaaaggttaatttaacttaaaatctagaaaacttggcagaaatcacatatgtacgtattaggctactaaaatatttcttactaactacaaatactaatcaagcatttcttacctactgtggagctaccattttcatattgagagagcagatcttcatcagcttgctcatgcttttcactaggagcaaagtctttcttagagaagctgctgttcttcttttttaaaagagctgctttactttcaggcttatgtgaaactggaatttccactggctggtaattagcatggatatatggttcttcagaaagcatataacctttactgaaacactctagcaaccactttgctcccactacatgaggcctacaaaaatagcacatagttatgtattagtgcaagctataaagaccatcatcccacttgtcatgcagtttccagaactgcgtggatatgcaattttaagaaaaattatgtagtagaaattgctttgaattaaaaacgaaaaaaacctgtgggctgatttattccaaaactgcttcaattcatcatcataatctcccacaataacatgagttacatcttcatttagctggttaaaacgaactccacctccactgttaataagtcttctcagtttatctagctttctgccactaaaaccgcaaagatatatctgcaagaaagaaaatatttaatatacataacatgctttctctcaatagaaaaaaactaaaaatatatatctaaatccactgtgtataaataagacaacttgtgtacatttaagatatatgaataaatacattctgaaacttttgattttttaacagttctgcaactttgagtttttaatcactctttacaatctcatacagcattatctttcacagtagatacttgataagtattttgtggctataaagaaaatagaagccagagtccaacatcttctaaatattagtgcataccaattcctaaaatgcaggtaacttctttaactgtgaagcttacttgtaaattttaaagtaattataaaagtaaactgtagttaactgtctgaattctgaacacctgggcttaaattgtgtgtgtgtggggggcggggggaggggttgttttttccagctgcctatgattaacgacaataggcaagttgcttacgctctttaaatcaattttcttacctataaattgatgttaccttactcacagagttgactgaacaaaaaatatatataagtcaaagaactgaacacaatgctttgaggataacatgtatgcagtaatttatttttagctatcagtatatatatatttaaaccaatttaatcaatataaaatcattttacctctattttacataaggtgcccttaaaaaaatttaagtatgacaaatctactccaaactgcatttataccccaaattaaatcacccccattactagaatatattttaacaaatatttggaatcatatactttctatatgtaagaaataattaaaagctatatctagaattagtagtctaggataaaacatcatacaaaacacctctgagccaggtgtggtggctcatgcctgtaatcccaacactctgggaggccaaggtgggcagactgcttgaggtcagaagttcaagaccagcctggccaatatggtgaaaccctcacctctactaaaaatagaaaaattagcatgcacctgtaatcccaactacttaggaggctgaggcaggagaatcgcttgaacctaagaggaagatgttgcagtgagctgagatcacgccactgcactccagcctgggcgacagagcaagtctccgtctcaaaacaaaaacaaaaaacccaccttttgtaagttggcaagtttaaaaaaaaaaaaggtaatttgccgaatttccctttttttttttttttttttttttttaaattttgagatggagtttcactcttgttgaccaggccggagtgcaatggcgcaatctcggctcactgtaacctccgcctcctgggttcaagtgattctcctacctcagcctcccaagcagctgggattacaggggcctgccacaacgcccagctaattttttttgtatttttagtagagacagggtttcaccatgttggccaggctggtctccaactcctgacctcaggtatctgcccaccttggcctcccaaaagtgctgggattacaggcatgagccaccaagcccagctccaatttcccttcttaacaataaggtagggttaaatttttgctactctgtgaaaattagtgcacagccaagtcattctacaaataggaatacattaagtattccaatctaagacagcggaaaaagtatagcatatgctgtttccatcaacaaacttataagacagttattcatatactaaaaaactaaataacccaagaaataccaaacaaagcagtggctctaatggtgaggaatacagactttggagtagataactggccacttaatgtctctctgtgtgactctgaacaagaattttaattctctaagtcttaccctcaagataatatccattttagagttatttgtgggacttaaatgcgattttatatatatattaacacacataaaatgattagcacagtgtctaatacactgtaaacacttggatgatagtttaaagtccaaacctgggcaacatagtgagaccttgtctctacaaaaaaattttaaaaattagccaggtgtagtggcacatgcctgtagttctaactgctcgggagactgaggggtggctgatgcccaggagttcaaggttacaggaagttatgattgtgccactgcatcccagcctgggcaacagagtgagaccctaactcaaaaaaattaaaaaaaaaaaatccaataagttgttcagaaactaagtgctctcgaaatatagcagatgaaaagattaatgtagttaggagggttcagagaagagttaaaacctgaaatgaacttttaaaagataacagaggaagataccttgcaggcagagggactctcgcagccaaaggatggacatggtctagtaagtgcatctacttagctagagtggagggtttacatagatagtaaggagcaagcccaactctgaagggtcttcaaagtcaggctaggaaatgctaatgtatatcatctactgcatgtattatataataaagacgtacccgacaaccatctaataaatcttcaggtgcttgaaatgcactgacatccagattttctagattttcaagtgtaggctccagtttgctgttaagtgaattacatattgattcacttacgcaacttgcatttatgttggaaatattgctgacatctgaaagagtacgacctacatattttgaaaacgtataaatttatgggagataaaataatcatgattacatattgtctatggattaacttttcttacaaatatagggcaataaacaacttccaaagtaagattcaggggtgtttactgaaatcttagtggcaaagtataaaaagggaaaatgaaattaattaagcctcctatcttatttaaatgaaaatagatttaacacattttcttaatagtgtcttgtttcccataaaaatctgaagttgctgactttaaggtccaagaagcttacatttgaaaaaatattttaaacattttgccaacacgacacctacaaaatagaaatggttttaatttttatacaaatacagatgatctataactgcagcaaaactgtaaattaaggaaagattaatatatgcatgtaatgtttaaaagattaatacttttatcttaagcccccagctaccattgttcttaatttctttgatcatcttttgcattacaacagagtataaaagacagcattcattcattctaaaagaaaattacgaacagttcagtgctaactttttatacaatttgactattatacaattatgcctagaagcacagcaaacaagaaaaagaaattccctatctcagtgatcctattaacatactgattattacatagaaatatgactgtcttcagaataattattttaatctcaatgagactcactatcaattgtgttgatctggctggtaggagttgaagaattgggcatagtctttgcttctggtctaggttctgtcttgtatatggattcatcctgacaaaaacctttctcaatactgtcaaaaaaccactgtgtggtcacacagtgtacattccatctcttggcacactcatacttctgacctgtggcgttcattaagaaagaaatagagaaaataggagaaaccaagaaatgaaaaccattacaatctatctttgcagaaatattcaaattataacaggttaatattttttttttttttttgagatggagtctcactctgttgcccaggctggagtacagtggtgagatcttggctcactgcaacctccacctccctcctgatcaagcgattctcctgcctcagcctcctgaatagctaggattacagacgtgtgccaccatgtctggctaatttttttgtatttttagtagacacggggtttcaccatgttggctaggctggtctcaaactcctgacctcaggtgattcgcctgccttggcctcccaaaatgctgggattacaagcgtgagcaaccgcgcccggctataacaggttatttcaaaaacctatcaacaaaattaaagttaccagtacttactcttaaacagtatgctacacagtttattacaaagtagtattttagcttattgcctaattatattttctatgtgtagtataaatacatatgccatgtgagaggttttatcttttatacaaactgcaggaagacagaagcaactgtggggtaacttaattaatattggacttgggtttgcatataggctccatcacttaatttctttaaaccagcttgtacaatgtgaaaattgtaaatttgtgctatataataaatcccaactttgaacagactattccaatgtcaacaggcttctacttaaagtccaggatagataagccaaaagataaattatattgaaaatatgtatcttttattaccttaaaaatcttcaacacaatgtattttgaagcagtatcacagaggaattgaggtcaatatgtcacatgaaaggttttttggcattcttgagagaatcaacaatgaactgtcttcagattcagaaaaagaacagcagtatcaactctactcacagtgatcctatcacaatcagccatactcaaagttctgacttaaggacaattaccatttaatcgtaatttcttctcaatctagatagcttagtaaaacacagtatacatataaagggcaataataaaaacattaacaaaactcatcttttatcaatttgtgtatattttaagagtgctgataaaaaattatccagaataatgttatgtaacaccaaacttaatagcaattttaaagaatttttcttgttcgtaatgtctttttcattttttactgcctcatgtgccgcaaggtgtgtcttccagttaaaactttgcaagatgttagagaaaacatctttgcaagatgttagagaaaacagtatcaaactagattaatgacatgtcagaagtaaaagctgttctgtaaagattttaaaatattaaatattagtggctgggcacggtggctcatgcctgtaatcccaggactttgggaggttgaggtgggaagatcaattgaggtcagttagagaccagtctggccaacatggtgaaagcccgtctctactaaaaataaaaagttattcaggcgtggtggcaggtgcctgtaatcccgctactcgggaagctgagttgggagaatcgcttgatcaagggaggcagaggttgcagtgagctgagattgtgccactgccctccagcctgggcaatagagcaagactctgtctcaaaataaataaataaataaataaaaataaaatattaaatactagagaaaatgtttcatttgtccctttgtgaaacacagttttaccttttggttcttgcacaatgaggtgtgtacattcattcattttcaattgtcccatgtattgacctccatgcttaactgtgagttgctgaacttctttcctgtctaagccacataagccagtcacacagattatgcaaccaagaaaaataggacacttgaaatcttccatgtttatatcagtatatctagttatttttctgtgggaatcaaatggttaaaaaagaacatattaaatttaccagaagaataatgaaaaacaacacaaatatcactattgcttccctcattttttaggatttataatcttttttttacaaaggagaaccaccaaaacagaattacactaattgttcacctagttcaataacatgtctctaaaacaaagtaattgtttcagatacagtctctcaaaaccattttaagggaaaaatatatatttccttaactctagcccttgctggtcatagtatattttccaaaatgataagtctgaatctctacttaaaaacccaaaggtaatttggttgcctattagataaatgaactttttaatctttccattattctatacaagtaaaagcaatgatttttggcaaaataccaacaaaaatatcattattctgttgccatgctagggaggtgtgctgatgaagtaatcacattgggaatgagagttgctgacatggagacatatttgggatatgctggatggtgttgaaaacaagcccagaaaagtgccgatataattcgtatgccaatacaattctgtggtgtttggtcttgtggttgtttatctagttgcaggggaaactgaagtgtgccccttgaaataggctctaagctccatgagggaagtgactatcttgttttgcttactacatatacctaatgcctacctcaagtcagatacgtaaaatgggctcaattagcatttattaaatgatcacatctcagctgatgacttgcatatgtttatattcaaccttacatatgccatcttttggaaggaatgcaactgccaaaatgactaatttattatctatcttaacatatgggaatggtgttgaaggataatgcaacataaaagctacagaattgccaaactcgttttctcaattatttcagaaatatttacagctgagaactttatcaccaaagcatttcctactctgtagctaatgctaaacccttggcccattctatgcctgtcaacttatatcttggtaataagagcttgtagattctgctcttccgttttcgctggagaaaagagtaatgacactatttttttccctgaatagtaagtccaaagagtatatcacatgccaaaaatgattgaatgcatcattttttcaaatctagaaaatataaaaatgtctttcttacttctcttgtgacttctcccaaagtgtttttatccaagagggaagcaaaataggtttcttcaggtttgcagcaactaaatattttttgctaccaacttctcctgcaataaggtgagttactgatacattaaggtctctgtatactcgtccgcccatcatttgtacatatttatgaacttcttcctgcagccccaaaagagaacacattaatgctgaagcaaacaatattgcttccacttttatacactatctcataaatacattttgctgttgacagtttgaatacataagtgttacataacattataaagttaaataattaaccaaattattttttgggagataagtatgaattatatttttaaaatattattttcctatatttatccctttcaactccatgaatgtattaaactattatacaaaggatgtataaatcttaatctttgcttctatataaatatacatgtgtatttttaacaacataaattatatctatataatatataaatatttatttttagccaggcttggtggtgcatgcctgtaattccagctactcgggaggctgaggcatgaagattacttgagcccaggaaatcaaggttgcagtgagttgtgattgtgccactgcactccagcgtgggtgacagtaagaccctgtcccaaatatatatatgtatttctatagctctctcttagaatgcttttttttttttttttccaaaacgaaatcttgctctgtcacccaggctgcagtgcagtggcgtgatgttggctcactgcaacctccacctccctgattcaaacgatttagaatccttttttttaaagactgtccacctatagtggaaaaatgtaagtgattaaaaaatgagtgtccttttaaattaaaacaaaaaatttcaattagccagttttcaacaaaacaaattctactatattcaatttacttaaaaaatgtacatgtatacatatatacacactgtggttgtatactgaactttgttaaaagtcacgaacaataagcggaaagtcttttaagctatcttctatgcagtgaaaaattaagaataagagatagatatataaattgatcaatcatcatgagatcaatatctacccttttttctttttccagacttgtacaagatatggttacatcagacataaccatattataaactggatgttcggctcttgggacacatcgctggtggtgcatacaaaatatgactacttgaggaccaacaattctgcagccaagctacaaaaaagagaaaagtttaaatgagttaagaaggaaaagaccaccagtcttacaaaattacattttgtaacattcaccaattctttaccaaagttgatgaccactgtagagaaatcagcaaatcattacaagaaaaaaataaagatgactatataatttctcagagatactatacattaaacactcacacacaaaagcaaatcaaacaatgcaagctatcaaaagaaataaacttcaggccaggcacagtggctcacgcctgtaatgccagcacttcagaggaggccgagcgggggtggatcacctgaggtcaggagttcgagaccagcctggccaacatggtgaaaccccgtctctactaaaaatacaaaaattagtcgggtgcagtggcgggcacctgcagtcccagtctctagggaggctgaggcaagagaattgcttgaacccaggaggcggaggttgcagtgagctgagatcacgtcactgcactccagcctgggcgacagagtgagaccctataacaaaagaaaaaaaaaaagaaaagaaaagaaataaacttcaaaagcccctttcactgaaaactgccttactgcttacatctataagcccaatattttgggaggctgaggtgggaggatcacttgagtgcaggagttcaagaccagcccagcctggccaacatcgagaaaccctttctctactaaaaataaaaaaatcagccgggtgtgtatatacatctgtaatcccagctactcaggaggctaaggcacaagaatcacttgaaccaaggaagcagaagttgcagtgggctgagcttgtgccactgcactaaagcctgggcaacagaacaagactctgtctccaaaaaacaaaaacaaaaacaaacaaacaaacaaaaaaagcctactgtaacataattagcctttcaatcctggtcttgccaaaccaaaagaattccaatgtactcataagttgcatagtactttataatccgcaaagaatgtatgtccattaaagcaaagataaaccaaaaaatagactaccaaaggtacacactagaagtcagcaaacctttttgaggtgatcaaagacaacgccactaaaagggtcacagatataaagtgatctatcattctcctttatcttcaatgcctcttcttctgtaataatctgaagatattcttctgattggaattcttttatggactgaaagaaaaaataaaataagaatgtacctgaaattactctcctgtatttaggtcctattcaaattccatctcaaatccagccttttccctattgaaagccaccatcacatctcacttagacctctgcagaaggctcccaagtggtctctttttcccttccttgccctaaatctgttctctacacagcagctaataatcttttcaaaaacacaagtcagatcatgtcactatctgctcaaaacctaatgtcttcacaccacacccagaataaaatccacatttcttactacagccttcaagacaacacagtctggtttcctgcctatctttccacctttacctcctacttctcatctctcttgcttattctattccagccactcccgctttcttgccaaccctggaacaagccaaccataacctcatttagaggctctgctcttgatcttgcagcacagaatactttttttccaggttttcacctgacttaatcccccacttcaatcaggtctgcttaaatgtcacctccccagagatgcccatcctaatcaggctttctcaaatacccttcctctacccttctagtctattctatttaaaaatacgtatttatatatatatatatagtttttgtctctctcccctggaagtttctatgtatcttgtttgctactatatcctgacacccagtaagcactcagaaatgttctgaaccaattttgaggtccttatgttaaatacagtaatccctttaaaactgtaagtcagatcatgtttactcttctgattatcaaccctccaatggctctccactgagagaaaaatggcccacaaggccctacatgacctctttaccattattctctaacgcattccttagtactcttcccccatccctcactcactacacaacagtacactaaacttggatagagactacaggcactttcccaggggctgtataaggttgctctctctgcctgcaacattcttctccagatatctgcaaggctatctcacctccttcacgtttactcaatatctttttcttcataaagcctaccctgatcacaccctatttaagattataacccccttctcttcccaccccaagaaacatcctctggaaccccttaacgtgttttgcttttttctcttcctaatttatcatgtctgattagtgtctatgtcctcctgctagaatgtaagctctgaaagaacagaaatctttgcctgttctcatcactgataaatcccaagtactagagaagtgcctatcaaatcatgaacacttcaataaatacttgctgaatgaatgaagtttaaaaaaatctgctacaaatgcttctcaaactttaatgcacactgaagatcttgttagaaatgcagattctaagtctgggttggaggccaagattctgcatttcgaagaaacttccaggccatgctgatactgctgggttctgtgagaagcaaggatctacatcacccctactatcatccaattattatactgtacataataaaacataatttttaacaattaaccaaaaaattttcaagtatgaccagtacacaactgactcaaatttctacagcacgcaaaggaccactctggctaggagacaaatgaaagcaacttaatttccaagaactgtaggtcagccatattaaacagcaatgtgataatagacttccagccccccgaaatacataatgatgtacttagatcaattcaaaaatatgtgataatgatatatctgtattaatgtagactataaaattattatgaaagtgaaatatctacttctaagacataaagcccaacaaatcaaaaacacttaaaaacaagaaaatgaattcacggtattaagatgttttcaactcttacctcgagagctttaaaaaaacatttggaattgtctgaagactttaaaaacttcacaaaaaacggttctttgtcatttctggacatttctgaactgtcaaaataaaggaaccattaacaagaacaaaaccacattagataaaaagttgcatgtttaacctacctatttttctgtgcagacaagaatgcctaaagacagacattctggctctgcccgtgaattcgtcaacggcatttctaagaaatcctggaacttggacaaagccaaggtaaaagatgacaacaccaatccttgcaaatcagacagcaaaattaacccgaattgaatacactgaggaaggccctgctatgaaggctctaagccctttaggccaatggacattcaattgcacttgttttaaggatacacagagtgtatctgtccctgcggatacccacggcctgcgaggtacgttcatccctcagtaaacagattttaaatataaacatggaagccagttagcatggtcttggccctgcataaggctagatgctccggttcccatctccaggaaaaggcctggctctgggatcacggaagccacgtcctctcggcgtcaaaggcccacccgccggctccagggccagttaccaggacaggaaaagagggtcctgaaggccacagaaggcatcgcgaaccccagttggggctggggaggagctgtgtccccactccgcgcctcacttacctcgttggagcctcggggtctccgggcggcgagtcgggggacgcgctggccgcagggcggtggctggggtcgggcgccagcccggcgcacagccccctcccccgactcggcgccgcccctaccccaaagcaaacgctggagaacccggaaattgcccagaacgggaaccgactttcgcgccaaccgcgcggccgcgcttgccttttccggtggaagtgacgccatcggcagctgcagcagaagagcggaaatgtcaaacgtggaggtgagcagtctgtgggcggtggggcttcagggaaagcttgggccggaccctttgggtttagggctttgctgggcgggcctagtctccgctgcgagtaggcccagcgccgtcggttcaagaggtaggaccacaggccaggaatactcctttactgttaaaaaagccagggaaagaaaggatttcctcaatagatatttattttacacctgtcttataccaggcatgcacgggaaaaggtattatccaaaacaattccgtgaggcaaatagtggtagttccattttgtagatgtaaaaacggaggaagttaaatgatgggttcaagggcacacggctagtaggtggtag

SEQ ID NO: 199 - DNA, 10662 bp, Homo Sapiens
tgggggtcaaatgaagcacgttattttatttcacaaagactgtacaaaattccttataaaacatggggtagatgccacctggttacctcactcggcccccatccaactccgtatgagggggcaggtgagggtggaaactgtgtggatggaatagtattatgtacaaggcaggggttgaagtgataggtacaagttctttcatatttacactatttcacatattcacaggtatatagagagccaggaggaaggagtgaactctggctcgttctcttgtataaaaaagcaccagtgtcctggactggacacccactgctataaaagatgcaggggggcccagggcctgatcgtcaccgactgatatcccgactggagtcccacaacttgttgggcggctcagcccgaaggcgggcgaagaaaggatgctgaagggcttcacccaaggtcagccgcttagctggttcatactctagcatgctttcaatcagatcgaagagctggtggtgttcctctgcctctgaggtcagataccgctggtggaggagggcaggaaaaaggtgaggcaggatgccttacaaaccctgccttcttcaagaccctacctttcattcttggagaaccaaggctctgcttgcaaccaatttgaaggctacctaaccacgaccacaccaggaccaacgtttctgatattatagctcaacctaccttcccactagcacaattactccataatctttgaaagttctttctacttgtatatccttgtcaacttcatgaatcttctttagttcctcattaaaatgtaagctcttcaaaggtagtttattcttttctgtctgacctaaagaatccaggacattgctttgatctctggttgtctcaaggttaggctgtctaacctccttccctccacaaaaccactccctcttatgtttcctctgttgaccaaagatgtcttctttcagctttcctcccctcctttcctaaccctctgcttgtgaagagcattccagggggcaaaccaccctaagaaggaagtgacttctggacggtgggcactatttatcccgagcccagctcacccgcagcggtttgcagttctcacgaacatagcgcccagctgatgtgttctcatcccaatccaggcgaccccggtaaaaatatttctgctttctagaggggaaggggaggttgaggaatcagaaggtcacccttgttacaattcccttatttccccatctgaaagtaactggggggagaggaggtatcaaagaaaaaagaaaatgatgtgaaatagaccaattctgtggagagaaaaggaaaagagttaactagtgccccctcaaggttcaccttgtctttcggatcatccgggaagggataggacccaagatcctttccatcatggctagatgctctctgttgtcatgggtctgggaaacaaaaacagaactgagcatgggactgaaaagggcatgctaaggatcagctgccaggaaggcaggcaatgtggagaactgagtaggcaggtcctcagcagaaaacaaaggaaccaggtagaagaatgccaggcagtcaagtaagacatcccatcacttacctggaagagggtgaatcccacatagtattcaaagatgatgcagcctatactccacacatcacaaggctgtgaccagcccaactctgggtgagaatgggagggaaaaggtgttatgaggcttaggtggccccaccctcacatcatctcacacacttggacagccttgccctcccttaccaaggatgacttctggtgctcggtaatggcgagtggagacaatggtgctatggtgctcatggtcaaaggtggcactgccaaagtctaccacccgcacagctgtgctcttcacactgcgctcatctcgcttctaggagcagaggagaaagaggatgaacctctgcacccagactgagattccaccagtattctctacattgcttctgagccttaaaaaaggtactgtgatctcctgcctggccttacaagccctgggaaattcctgttttacagcttccaccacatccagcataatacttttagaagtaggggagcaaaaggattaagaaatgattatagaacagcgtgcacatctgtaagcatctgaagactacactcaagtgccagatatatagttattctgaaaacatgtaacatgtagcaaatgggtttttctgaaaaaatgtaacatgtagcaaatgggtttttctgaaaaaatgtaacatgtagcaaaggagtttctctaaaaatatgtaacatgtagcaaaggggtcaaaggagggagagcttctttaggtctgagatctccattatctccagttagtcaaaggagccgagctttcctacctcacagaaatacacatctcaaaaaagaagtccgggccaggcactgtggctcacacccgtaatcccagcattctgggagcccgagacaggcagatcacctgaggttaggggttcgagaccagcctggccaacatggcaaaaccccatctctactaaaaacacaaaaactagccaggcgtggtggcgggtgcctgtaatcccagctactccagaggctgaggcaggagaatcacttaaacctgggaggtagaggttgcagtgagccgagattatgccactgcacatcagtctgggcaacagagtgagactctgtctcaaataaataaataaataaataaataaataaataaataaagtccaaaccaagaaccttaaaaactttcactctactggaaagttatctgaagtcccctgtacaagttatctcccaatttaagtcttcttaagagatttctccctttcaacctatttagttttacccagttggagccagacagggagaaaatgtgggaggacgaaataaaagggagaaaacaaagggctcggcagaaggcaaagtggtgcagctgcctgcccccagtaaccaagggcagaccctatccatcttaccttctctaggttgtaggtgagctcatagtctgaattcacaaacagaatattttcaggcttgaggtctgtatgtgtcagcttgttatcatggaggactgtaggggagaaggccaggtcaggcttggtgcaggtggccagagctaactggtatcagctgaccccaggcctggttacctagggcaaagccagtgaggagacaggtccagaatcactagggctgctttctgctctacgtctaaatggaatgcctggtctaagaagctctgctctttctaatgtaagatacatatgtagctcaactgatgtaaaaaaaaaaaagtttgctttgagttgtagtgtgtacacactttgacatgtgtctagctggcattatgttaactcaattctgtgaaactgtattattttgatgactccagaggaatgatatatttctttgaattccccaccttgccccttagctgaactacatactctgtgttcccatctcctttgctgtgaatgaacatctcatcccagacaaatgtaagcctttaccctaaggagtgtatttttgtctctttatgtttgctgtctgactgatgctttcccaagaaagggagaaaggaaaaggggagggtaattaagtgctttgattccaaaggctttctcttctagctgctgctaggctaggtgtagagtaagagcaatcagtgacgataaagacatcagtcaaggagttaagtcagaagacgtttcaagatgacagtaaatcaaagaactgcagataacagacagctgactgtttaggggcttcaccagtgcacaaccgacagagagatccaatgaagggagggactgccccagagtccacttcggcccaccccactcacacttgacagcctggcacagctggaaggccatgtggcgcacttggtggatggggtagggcaggtagttgttgtctttgaggaaatcgaaggtgctaaggcccagaagctcaaaggagatacacatgtggccatggtagtcaaaccagtcaaacatctggacacagaggctgagaagagagatgggggaaggggggttgtctgatgagctcccatctgcccatcagccatccaacaaggaggtacttcatagctgttgattccacatacttgtgtaaaaccatgccagctagtactaacaccaaaattcagttcagctaaggagtagcctctaccagacccaagaagaatggtactatctgccaggtttttttcttttttgtttttgagatggcgtctcactctgtcacccaggctggagtgcagtggcgcgatcttggctcactgcaacctctgcctcctgttcaagcgattctcctgcctcagccttccaagtagctgggactacagttgtccaccaccatgcccggctaatttttttatttttagtacagacggggtttcaccatattggccaggctggtctcgaactcctgacattgtgatccacccgcctcggcctccaaagtgctgggattacaggcgtgagccaccatgcccagcccaagtttcaaaatatcttcctgcgtcattttaaatagttcaaaaactatttgctgaagagctgtggagtgccaagctccaaacagtatagatcctgaatcatcaaactgtccatcctaaatcccaaccccagcccaactcctgatattcattcaccactagctaccactgggctcctatttatacctactggcctcatatcttggcttaaagtccttattctatttttggactgtgaatgtatgtgaacaaaatattactgcataaatgtctgtggccttatcagcatagttctacttataaaagcttaattcattgttcgatgaggttgatgctcagtcctagggctatgtccagggtatatctctacagaagccattctaggctggggtcaaacgacagagcaatctaacttccctgaaaacaaggggagtggattaaggaatgtcatgggccccccccctttcctaccctgatgttctactactctaagatgatgaacaaaagatgaatggatgagaaggtctaggactcccctgtctgcctaaaccaggtctagaagtctctcccgtgtaggggttggggctctcagcctccctacatacttccttgcttgcttacttcttgttgtcagggtctttctcattgattttctctagcacgttgatctcaagtcgagctgcttccttgtacttctccacattcttaatgatcttcagggcaactcgagccccacccctgtaagttggcaggagaggcttttgctgggttctcaagaatgtctcaaaatgaacagggctgtagggggactaagaaattctacctcaggttaattagcaaaaaagccccatataaccccaaccatctctttagccccacatagtagggagggactgacagttacctgcgatggtcaacacattgtacaactcggccgaaggtcccctctcctaaggtgctaacgatttcatctgaaatgaaagagagcagggtcggggagagggagggagagaaggtggggaatgagctgagttggaagaaaaaaggggacagcaacctggggtggagatgaaggaaggggaacagatacagatggtcacaggggaagaaaacccctgcgtgattcccaccacctttaacccaggggccgtgagagctgggagtggacaacagaggtcaattctcaacagcaactcaaaccacccagataaacaacaccactgagaaaaggcaagaggctgtgactcaggttggcttgggacgttaggatggctatgggaccattacaggctataggattgttacgatttggcttgtacatcgctcttgtagccagtccccgacgtggtagatgaggtggccctcagcgtcgtcctctacactcttggctctccggctgctgtgctgctgtcggggggcagggggggtcggagcaagccaggtgtcggagcgggggccggagggaggcggggtgggtggtagaggggtcaccggtcacaggcgcccagccaggggggacagacgatgatgggggacagtggaagggaacacgtcagatgcagtaaggtggatcggtgtgagaagagagagcggcgcataatcccaagtccccaaacccaaaacaggaacagggagaggcatgggcagagcagagaagtggtgttgttgccaatgtcacccacaaccccatgctctacacaatgcccttccgggcagacacagatctccccttgcccccacccaagcccgcctgccaagggggctacagagcccagggcttgggggaaaaaggcagttcacaagcaaggtccccattaaagagtggaggccgctggggcggagaagctgctcccaacacaataagcccaacatgccagggagagcactgggggtcacaaatgctccgtgcccatccatctccaaagcagatccagggcccttcaagagtcggagagcttccaagaaagtaggcaaactcagtgcccacctcagtgttcatgccccaatgttcagctgagaacaaggatactgctcacttaccagagtcctagagggcctgcagaagagtggggagaggaagggcctgggctggcactcaccgaagatgagcggctaaatgtccggctgcgcctcctccgccgtctgtgcttcctccggctgctgcgctggctgcggtaactgctgttctcccgctgatattcataggaatgccgatagtctgtgtcatagtaggcatctccccgatcccggctataatcgttgcgtctgtagctgccacagtatcgccggtcatacaccctccggtcggacgaacgatcatcataactgctgttggataacaaataccaatgaggtgtatctgttcagatcacattccctaccataccctgtgacaaggtcctgccttagtgaggacaaagagtaatgctagaaaactgttctcagacacttgttgagtcactgagaggaccaagggaccagagaagtgaggtaacaagcacatctgccatgtcaccaaaacctctgaaaaggcatctgcagaaccactccctattggggcctttttcccgctgcagtgatacaaagaaacaaagagccatttttttctcaagctttcctgaatgaaatccccccttgctctaaaccatccttaacccattctttccactgaacataccactaaaatattaaaactgggccgggcacagtggctcacgcctgtaatcccagcactttgggaggccaaggcaggtggagcacttgaggtcaggagtttgaggccaacatggtgaaatcctgtctctactaaaaatacaaaaaaaaaaaaaaaaaattagccaggcatgatggcgcatgcctgtagtcccaggtacttgggaggctgaggcacaagaatcgcttgaacctggggccatagagtttgcagtgagctgagatcttgccactgcactccagcctgggcaacagagtgaaactctgtctcaaaaataaataaatgatattttaaaatttttaaaaaattaaaaacacaaagatctaactttgtcttatctgttagcttattagttacctgtagctcccagtcctttgcacatgctttccctctgcccaaagacacttcccccacctgactctacttgtcctccagacatatacagatgttgctttctctgcaatgttttatctgaattaacatcctgccccactccaaccaaacgcactgggtacgtcctcagttcctcattatgtattctaacacttaacactgcagcccaaatggcttctttggttatctatcccgacattaccttcagccagctacttaaggcaatggttttagcatataaccaataagtatttgttgaacaaaggaatgagcgagtgaccctgtgtttgagtatctcttcctgaggcctcaccttcgagaacggacatggtagctgtcctctcgccgacgccgtcgtgtccggtcactactacttgaccaggagcgacttcttcgtcgcttatgctttcggctccgatagtgttcacggtaactcccccggctgcctcgctctgaggagtggtaccttcgaggatgcggcatctggaaggcaagggaaagcggaaataggaaagtttcgagttttcagaaatctcctccaaggactggctgctccaaagatgctaagctgctttcccctcttatttctgcctctttttaccaggcacaacttcctcagtcttcctctgtacttacaattcctccttattggagtacagccacctactaactctggctgaaactctagaaagcccccaaacccatccctcattacccacccctcagttcaagtgttcttattttattcttgagacagagtctcgctgtgtggccaggctggagtgcagtggcacaatctcggctcactgcaacctccacttcccaggttcaagcaactctcctgcctcagcctcctgtgtagctgggattacaggcacgcaccaccactcctggctaatttttatatttttagtagagacggggtttcaccatgttggccaggatggtctcaaactcctgacctcgtgatcctcctgcctcggcctcccaaagtgctgggattacaggcgtgagccaccgcacccagccagttcaagtgttctatccttattttcttcaaacacagctccatgaagaccttcaggtctaggacacagttcactacagagcaaagtgtatgacgaccgatggagactgccacagtgtatccccgttcaggatctaagatatagatctgtgtgatgctgagttcctcacaagtcaatagagtaaagctttggtttacagttatgataaatgttgtacactcattaagagtacatctcatctcctcaagtagactatcagtgtcctgagggtaggaatccagtctcccaggtttctacatataccaggtaaacgccaaatactatcagctccagggatctgggtcgggccccttgaattaacttaatcatctctcacatctttggccaactctcccttgagaggttttaatgtagtaggccacaaaatacagtcagcatcccatctggcccctccactcttgtgcttaagacgtagataacaactgtttcttgtgtttttttttttttttttgaaacggagttttgctcttgttgcccaggctggagtgcaatggcgcaatctcggctcaccataacctccgcctgcagggttcaagcgattctcctgcctcagcctcccgagtagctgggattacaggcatgcgccgccacgcccagctaattttgtatttttagtagagacagggtttctccatgttggtcaggctggtctcgaactcccaacctcaggtgatccgcccgccttggcctcccaaagtgctgggattacagatgtgagccaccgcgcctggccagtaagtggtttttaattaatatcagccctacttagctgacagctggccaccttccagttaatggaattggaatgggatggttcacaaatcctttttttccttcaaggaaaaaagagaaaaatcactgtcacaatccaggaagatgagaataggaaggcacaataaaatgaaacaggcccagggacataagtcttggtgggggtgtatgagaatcgcgtatgcaaaaggtttaatgattccgatgtctgaccaccattctgtatcacttcttcccaacctccccaaattgaggagggtggtatttgatgcattcttggtgtaactggggccggtagcataccaagctgcaagcacaagattttcccagcatagttatcctaatcagcatagccacataaatgccatctcaccacatactaccatcaaacggcctcacagcactgtcccctcaaaacatcactagcctacctttctcaagtttgaaatcttttgctttttcctttcttactcagaaaatccagaactcctacaggcaaattcttcctgcatgttccaagtgacacggtgatgtattcctcccctccagctttgattggacccgagtccaactttgatattccactccttcacatctctggaaccactcccatccttactctatcatcccttctagtctggttccgcccaagcttcctacaggtcttcttggtacatctaacgcaggccgacctccttccccctcatctccctactccgtcgcttcgtaggtctcaactctcctcctctccaaatctcgcccccgtcccttgcccccaacccaagcctaaccccgcccgccccgcggtcgccatcttttcgcgcggccagccaacccgcgcgctcaccgttctggcggcgaggcccgtgcgcttgtcccacaggaagtccgtgatggcggcgacactgcggccggagtcccggcacccccgcggcgacgaaatgctgctccacccccccaacccgggaccctgggacctcccgccccgttcccgggctccgcttcagtcccgcccgccccggctccgtccccgcccctaagatctgcttggcgccgctcgcaccgcccccgcccggggcccgatcccagctcggtctccggctctggcctctccgctccgccgccgccgccgtgagcgagcacgtacgcacggaccgacgtcctgcgtcgcttccc

SEQ ID NO: 200 - DNA, 15936 bp, Homo Sapiens
tgggcgtttttatctttttgtattaaaaaagtagtaacagacacaaatatcaaaaacacaaatgccatcggcagagggtacagctgagaacgcctgggtcccacctgaggggcagcaccagggactccatggtccaccaacctcccccactccagagcagctaggggctggaacccccgggtcctgcttgggcctcaggctctcctcccatctggggaggaggtgggagagagagctgtctccccgcaataaataagtgcagccccaaccctcaagagtcagattcaggctcagctggaatatggagaggccacttcagcagcttgtcagcaactttgtccaggggagggaaggattcctctccaaaggtgggaggtgacactcctctgggctgggctgcggagttctgctctctgctccctaagaggccagaggcagcccctggatcctaggctggtgatgggggtccggccccctatggtgggagaagctggggcagtttcccactggttggtctagccacatctgagttctgagaattgggacataggagaagaaagcctctcatggactcctggagatggtcccagaatggagtctagctggtgcagtttcctgctgtaggtaaggctggactggatgagctcctgccttcttcctcctcctccatagccaagtcctgagagcttgaagccttggccccgccttgggcctcctcgcagccctctccctcaccactgccgccaccgctgctgccctgctcgcctccaccctcttccatgggctccagccccagtccatccagctctgagaagagtgggtcatcagggtgaccaggatcttgggtgctgctcccacagtccacacaggccttggtgagagaaatggacatgagagagtcagacagggttctcactgctaacctgccagcgcagcttcccacccccagcccactgtgcttcccgaaatgtactcccaagaagcaccagtccacacagatgcacctgcggtccaacaaggttggacagtgccttgtgccctctacccagatgccgttacaggacagtcacaatgcatattagcataggataggctgtgaaaagttctgcaaagactcacgcggcttaatattctataatccacagcaaatttagtggaatcaacattcttcagaattaatgatccaaggacatcaaggagatcagctcttggcctcgatcccttgaacttgagctcaattcttttttctcccccttgaacttgagctcaattcttttttctcccccttgaacttgagctcaattcttttttctccccgtcccaggcttctctcaccatcacatcaagagcccgaggcagttggcccttccggacccaggagtgcacagcacccagttcccgccgctggtcctcagaaaaccgaggctgctgcttctgcatggctcggagccgctcccgatcctgcttcagcacagaggtcatgtccctgcccaagaaggggttcagaaggcagaggctgggatccaggacccggaccaggacccatgaagctggcatccttcctctaccacagcttcccacctcatgctcctcccctaaactagtgctatgcgaggtcaaggcttccaagaccaggaaacctgctctcctcctgggaggaactagtaacagggctccaaggagcaggaagaaagatagaaacgtttatcctatccagggcagagccagccccagaaaagaaaactgcccccactactacctctgaaaggaaggccaagaaggcctctgaaatgcctcacctggagggcacctggtaggtcatcatgacgcgctggtcagcattggccatgagcagccaaatgggatcctggagcacgtacttaatcacctggtccccaggctcagccccgccccgagcagccccagcctcagcctcggaagagtcgatgctgccaaagtatttgcttgtgtggctgctctggctgctgcctgtgaagtggggggcagaccaatgggagtcaggccggctgcatgcccactcctgggacctcacaaggcctccctcaaaggccacatgtccatcccagtggccttaggaagctccgccaagacggggcctgggctcccggctccccaatcactgccctaccctgggagatgctggaggcggggtactcacgagtgatgctggctgaggtgctgcccccttcatgggagcctgaaccagacccagagcccaagccagagcccaaggagcccgaggctgcggagcctgtgccggagcgcgagtcctcttgcagcagaagttcgagcaggtcactggagccggaaagtgcgtcctgattggaggactcagtgacctccgcctggaggaggggaggggggcaaggagggatggaggggtcagcacctaggcctcccttcaactgctcttactggttgtggggagaggcacatccaaccccagtggtctctgctccccacttcgtgacagtagggccaggctgagagagaagaaagctggcgaagagtggggatgtgaggccagaccctttccaagtgacagatgctctctcagaagttattgagatgtcctcaccacctgtcagacagacaggactgtcccttcaaagaggaggtagccaatttctgcctcattcagaaattcagctggggactccctccacctcctggaggctgagacgccagcctggcagagacagcaggcagcacagggtggcagaggggcggggctggggtgggggctggcaggcagacgcaggggtcagtgctcaccagtctggcctctggctcagcagcctccgcactgggaggtgggggcccggcactgctcccagggcctcctgcaacagcagccccctcagcacgggggagctcctccagctgcagcagattgagctggagtggagagctgcatctcgagttgaacagtggagagtccgggcggtgaggaggactcggggcgagggcgggcaaggatggagaaggggagtgcgaggcaggagtgggaggcccttcagcaggggtctggagtgccccataaggatagctggatggggttgggaacagatagttagggagcaccaaggccaccattggggtcaccaaaggggcggggaaagcagctgggggcacagatgtgggagcagggggaagaggctgggggcctcctcgaggagagaacactgggagagggtagggctggacaaccgctgggaagggggtagtggctggtggggtgggccagggggtggagggtggcacgggtgaggggtgtgagacatagcagggcgcttcagcccgagggttctggtggtggcgtgagcgcttggctttggatcggcagtggtgtcggcggcttgggggtgcggggccgtggtggcagcctgtggggagagactagggttagcaaggacctcaacctggggttagtacccctgctacccacactgccctgacacgctgaccagggagaggacaggccaaggtcccagagagagcttctcaacccacacagaacgggggactcaggaggtggggcaccttcagggaagaatcacaggagccagggacaaggggatttattgagaaaggaacaaggccagggagaggttacacgaggggtcgagctgggggtgtgcggaagatggaggcatgctggcagatggaggaagcagggtgagtccatggacacatggacagatggctctggtccgccaaactcctgtgggcactgccagcctaggcattcctcctgcccatcgaggccgtattctgcctagcttgcaatggagtgaagagtggggctggaaagcccagtcctgagtcctgcgtctgcctgcaggggatctccctcaggcacctggaggggctgccttccacctgcccttgaagcccagaccccacccagagttggcccagaatctatgcatgtctcttcatcagtgacaactgactcctaagtgggcatacttcctgcccctgcccccaggctaggcctgaagtcgcttacctggagacagcacctctgcctgcccatcccagtgccatccccccaggctgccctcctctggctgcagcccggaaccccatcctagtggggagaagctagcgaggggcctgtccctaggcagggcctagtggtggaagcaacaccagcctgggtccctggagcagaaacacctcccttaagacccaccccccaacaatccagtcctagactgggcagagggcaggctccaggaggccccaggtggctacctcgctcgccaagggctgagggagctgtggaagagctgtcgagtccacgcagcctgcccaggtctcggaagcggctgaggaaggcttgctcttccttctgtgtgtgcagggacagcacggccttggtcagccccactggacggtaggcgtctggggctgggtcaggggctactgtggggctgggggctgggctgggggctgggcctggggctaggccaggcaggtcctccatcatgatgatgtctgaggagagtgagatagggaaaggtcatcagaaccacttcaggggtcaacacatccataccacaccctccctgtctgatagcctagccaacccctggcagctctgccccacagccaagcctggtctccatgtacgtttcttggtcacctctctgccaacggctggccctgggtcctcctctccatgcaaagctggcccagaagaagagacgatactcaggcccctccagtggccactccctgccaggaactctactgggatgaccccgtcacaactctcattggaagagaagcccaccccttggccttccctcacacattttcttgtttctttttttttttttttttgacatggagtctcactctttctcccaagctggagtgcagtggtgcgatctcagctcactgcaaccaccaccccctgggttcaagcgattctcctgtcccagcctcccgagtagctgggactacaggcgcgcgccaccacgcccggctaatttttgcatttttagtagatacagggtttcaccatgttgcccaggctgatctcgagctcctgatctcaggtgatcctcctacctcagcctcccaaaatgctgggattacaggcctgagccaccatgcccagcccctcatgattttcaaggtcaatatccaaagacccttcagggatgttcaattttccttgccttcagaccctgtgtggtcagcacctcagggcaaaccctctatcccagactctgtgtttcaactgacagtaacaatacgagaagcagaacaggggaagggcaaagccgagaagcctggcagggaggggagagcaagaagcagtagccccaagccccaggtcaagggaggcctccttctctccatcaggccctagaggggaggggaaaggcaggagggagctctagctgggagaccggtggagcccaagcactgccccccaattccacacccatacccgactccgggggcttcttgtctcccacatggacgatggtggagctgaagctacactgactggtgacggacaccacactctccgccttattggccagggcgagcgggctcagggtgcctcccaccactggctccttccgtggggtggccccctccccagacagcgctgctgacggcggatctgtgcagagagatggtgccagttaccatccccacccccactgggaagtcaggagagaggatcccagggaaaaggggaaggggatggtggtagggaacagagggaacagtctggagaccaggaggctggggaggagagcagggcagagcaagagggcccagaagcagaagggaaaagacacagggccaccaggccaggacggggcagtgggagcagggtgcattggatctttacctttcttggtccccacagagactggacctgtcctctgcctgtcgtcgtcagaggctgaggaggtggtataggaggaggaggaggcacatttacgcttagtggtgctggggaggttgcagctctccaggtacctggggatggacacagcacagggcatcagagcagggcttggggtgggcagggttagagcccgaggtggagaagatgcctggcaggccttacctgaggatgctgtccaggcagttgatctgctggtaggagcagctggaggcttctttcctctcggcctcctcagggaccaaggctagtggggcctggacgggagcagaacccgcctccagctctgggtctggggattggcagggaagggccttggccttgaacgtgcctgtagctggggcaaagagagaaagaggaaaatagccttctcaagctcacatggaaaaaaacagcaaatgggttgggggtgaaggtcaggggaccccccaggtctgtctcttcacccacacatcatcatcaactcaccagggaggcggggccgggactgaggccgggcccgagactcaataaaaagctgctggccctggtgcttcaccagatgcacatccttacagatctgctggaaagtcacctgtgggacacagcaccacagtgagcagaaccagggggtgtcgccagtgtcaggggccaagggcacaataaaacaagaaggtaccagtggggaggcacagacgccttgatgggagcaggacaagaaggaaaaggcaggaaggagagggcaaaggaggatcgggcaagactctgggactggcagtgctggttccaagaaggagaggggaaagggcgattagagggtgaggtaggagcaggtcactcactggcgcaggaggcccaggcccctctgcatcacccccgttgctatcactggaggacccagggctgtggagagggcctggggatgtcacggcgccgactccacagagtcccgtggggctggggctgtggacgggctgcagcagggagagggcaggttagatggcttgacccggcttcccacaccttttctcacctcccaggctccctctccgctactctcacctgcagcagcagccggtggatctgctctgacagctcctggatatcagtgtccagggagggagctgggctgggggccgggggagtgaacacgtcctcattcaggggggccctgtagagtgaagagtgaatccagccctggcccggtcctgtcccccaccgcactgccctatccccaacgccagctcgggggcatggcccacttacgtgcgtactttgtggcggcccaacacgaaggctaccttgcggctccaggggtgcacaaagccagcccagctggtgtccatggtgacatactccccgttgcgggcacagaagcggataggggagtggtcaaagggctggcccgccaactgcagaactgatggaagtgggaaaggaggagcggtcaaagggagggagagctgagtaagagggaggccatgccactagagatccaggagaccaaggcaccaagagacacaaccacaagggcagccactcaaaagcccaggacagtgggaagggcgagcagggcgagaggaactcactcttcttgtggatagccagcatgaggggtcggtcctcaggatgcaggaacaggagcactggggcccccaggaggtcctggggcaggtagcccagcaggggggcagccctgaacgggaaggaggcatcagagtggccgtggcctcagccctggctgccctcgtctcctctaggtcctatcctcacctttcatccacatcctggaagaggcagctgggtgtgtgccgcgtagtgaaaatcctcttgtcagggggtatccggggagctgaggcacagagagtgtggtcactgggtttcgtccagaatgcccaactcctcagccctccactctgcctgggcccaggctggctgatgatctgccacacagctctgccccgggcactatgggcccaaagatggtctgggccaatcctatgccctgtatcagtaacatgactgagagcaagcaaggcattcttctctgccctcctctagcttgggcaccttattcaactctacctctaagaggagctcaaatcctcatctttacaatagcttttcttgttccaaaattcaaagggtgtggttcatgcctcccaaattcatgtctggccatgaggaaatgtccttcctcccagcccccaccaggccagggccctgacctgcccaccttcgtaacccgaatggatgcgctctgcaatcagcaggcagcacggctgtgcaggggccccatctgagacccggatcttggtcacatacggggttaggcggaatggctggtaccgaggccctggatcccggtcaggacctcctctagcaaaggagagaggagcattagggactttcaacagagagccacccactcctccaacaataaggtcacagcagacaacagcaaagacgctggggagggggcaggaggaggcagaggtaggccgggcacggtggctcacgcctttaatcccagcactttgggaggccaaggcaggcggatcacctgaggtcaggagttcgagaccagcctggccaacatggtgaaaccccgtctctactgaaaatacaaaaattagctgggcgtggtggcgcatgcctgtaatcccagctacttgggaggctgaggcaggagaatcgcttgaacctgggaggcggaggttgcagtgagccgagatcgtgccaccgcagtccagcctgggtgacagagtgagactccctttcaaaaagcaaaaacaaaaacaaaaacaaaaaaaaaaggaggcagaggtcttctccagttcccctcacctacctgatacggcagaagacggacttctcctgggtaaagtccctgaggcctgaacctgggacagacaggagaggagtgagcacagcttcctgccccttccctaggctgcgaagaatccactaagggaaagtctgggttccccggcccctcacagcaggaatttcctgggactgctcatgcctccccacagcgcttgggcacctcacctgctgaggcccctgtgccccaggtgggcaggcgagatggagcagtggaaccatagaagactcccacatcctggggagccaggagctcagagaagcgggtaccccggaacacgtcccgcttgcaacgcagcaggacggctgcctgctccgaaatgtagacgattcggcccgtcaggaaggagacagccactgagaaggtatcctggcaggagggggagagcaagagcagattcaagagctgtgggagaaggagtaggggtgcgtcgggatgcagaggccaggccgccgctgacctggttctgaagtgtgtactcagacgtgatgtgctccagctcctccagggtataggtggacatgtccatggagcaaggctcgccctcctccaggctccactgctggtagtattcctggttggctgcagagtggaggcagtgaggcattcagtaaggaggctgcctcaacacgggagcccaggcccaggccattccctcttgggacacaccacttaccctgcacctgcttgacacaggccagtgcgtactgcagcgtggccagggtcccagagcggcccttgccccggcgctctggcggcagtcgaagcttgagctctcgaagtgctgtcatgagttccttctgagtccttgcccgggctgactgttcactgctgcggggcccacagggaagaaagagataaagacattagtcccagagtgtggcctgggcccccagacctctcctccagcctcacccgacgtacctgcagccactggtggacgggttgtcctgctctgagctggcactcaggaggctgtaggcaatggaactgctgggtggggatgggctctgagagtttgtgctaggagacagcaacaggcccagttacaggtagggccagcagtgcgaggcctgtcacccagctctgcctgctcacaagaccattcctagacccaacatacacatccatacacacctcttgctgctctcagtggtctccagcagggctgagtccttgccgttgcctgaggaggagctgtgtgagctccgctgagatgcgcctctagactcatgcccgttggactcattgccacttgaaccattgctgttggcatcggtgtcatcggccaggctggggcctgggcaaggccggtgctgtgggggcccaggggatgggacgcccccaggacaaaatgattccccaggcctggggtcccctcccccatcagccccttctagggggccactcatgtctgggccatggggagaacagaacagagaaggcagagaggccaccacggatgcacgagggggcctggaggcttggctgagggagtgaggtggaagatctaagtctctgagggttgagaagttcgatcacagccagtacctggagagggagaccaggaagcagggcttgcagaaagctggtttaactccagagcacctgctggcttcactcagaccttccccctgcctggcctcctgcaggactgatgggagtggaacccaggcctggggcttccaatggggagtcaggatgtctcctgtacccttagggggactgccagcgggagaaggttctccggggccttccttcacatcccctgccaccatggcctgagcagtcaatgagaaccacggctgtagacaaaaacctggacacttcccattcccaagttcccattaggtgtccactctgcctgggcctccaaggcctcggagcaggaggtgagctggtcgcctcctatatttaggcctccaggctaattttatccgggggcggtgccacccccgctgcacatgcgcgccgacgtgcgcggccccaccacgcgcttccgccgccgccacggtcgccagggaaaccgacgtcagctgctgagctcagcggttgctggagggaccacaggagggcgggaggagcgacccctcccccatttcccggcggaagtgggggaacggcccactctcacactggtgggcgcggccgggggggtcacgcatcccttacatatccccagtcccaggatggctcggtggccgtaagaagtgggacggcctattaggatcccagggttggtcctggcttccccaggacgaagcacaacggccactgccctcggcgcaaaagcccctcaacctgactctcgcctggatcccagtcattctggtcaagacaacacaacctttccttctttagcccctgcgctgcttccccaccacaaggaccgaagccggcaacctgccatcgtcaaggacccgaggatcctctctcttcagtcccctacttttctggccagacccccccaccaaccccaagccttgggcagaagacacacaacagccaacagatctttcttcccctactccccgtccaaccacacccctactactgagcattttctgagcgccaggggaaaagggaaggttgtggccaacagcaggaaccagcgctgggaacgggatgttctagtccgaagtgggctgacatcacaggcggcgcagggccagggactggagaacagagacacggggagcgctgaaagcctaatagggtcctggtaccggggcaaacctggggcccctcgagtaacgagcaagaagaccggggcatgcccgctgagagtcggctgtggggccgggaaagctgggacggggaggtggggacaagctggaggtaagatgagtgggtcaggagtgcagactcccggtgcaagatttcgaggaggacttcggtccttgggggcagggagagggtgggtagcggtaaggacgacagtgtgccctctgcctgggccgaaagtagcccatcagattggaagtggcagcggtccggctcagggacggagatcggccccaggatggccgcagagatgcctacctggtcgcaggagtgtcctccgcacgcctgcccgccgccgctccagcccgcagccgagtggaagctccaccgggcgggcggggaggcgggttgcataatgccgggcactgccccctcattggcctcttgccgacggagccgcaggccccgcccccgattggctggggatctcttcccggcgcctgattggctagtggtctccactaaggtcagggctgtgtcacacacacgggcgcacgtggacctgggtgctggtgctgggctgaagagccccagacaccgcccagccaatgggcgcaggacgcttgcacattgaataatggaagggaggagagagggagatacgctgcgcctctttagggaaaaagcccggcccggggtaggtgctcaagacttgtctacttcctgaacgcactagccttgcagaacacaacatcttggcatcttcgcctttccaagggtgaggaaaaggaatggcgctgcaagttaggccacgctggatgagatgggtggtccttgagaggaggggagagacagaaacctgcctgggcctctcctgggttcctttcccaaccttgttccctcccaaccttcgttctacataatgaagccctttaaccgaagcacttcctctgacacttcaaatcctgggagaggacagttaagggtccacgtgtgaccggtgggtgagtgggtggaggaaggatgcggacaatggaaggggcaaccagagccaatagtggctgtgaagggaaacaatggcaggtgcttctatggccactcagagacaaggtctccgggcagcctacgtggtgtctagtactttcctccagaggacgcagccacccacagttaaagctgccccaaaagtgggggccaggaagccaggactacagagggaccaaggggatggcccagagaagaggccagctggggccctagacagagaaatgtggggtggcaagggcttcatatttccactgcttggaaaagagaaagccaaactccaggggcccagacggaacgtcatctgtctcattcactgtagtctccagagcccaggacaggacctgacacatggcaagtgatcgataaacatgatttttttttttttaaacaaggataggttggggaggtgggaaaagagtgtcaacaggagaaagggggctgggaattctgattctctaaaagagatgagtagtcctagaaagagaacaggggcacgatttgcaggcaataaaatgttagtctgggctcaggagagctgcagttacacagccccctccatccaggaccgtgatgagtagttcctcgcagggctccctggaaacgtgggtagtagatgaacaggcctccaagcagctgctgacataatcattgtgggggcactcccctcactgtcacgtggcctaagctttcctgaacaatgagggaagggtgaaggggagggctctgtggaaaagctgagacaagatcgtgttataaattaacccagaaaaatcgaaacaggaaaacaaaagattcaggagcctggaggccgggcgcggtggcctgtaatcccagcactttgggaggcccaggcaggcggatcacctgaggtagcgagttcgagaccagcctgaccaacatggagaaaccccgtctctattaaaaaaaaaaaaaaagattcaggagcttggattctcagtctcctctccctgaaaatgatcctctccaccccaactcatactgtggctttggccttatctcgtttgcagatacctcttccctggaaacatggtttttctcccccttcagggatttaggtgtgatctcccctaacccaggcagtccttgatctcccgcctccatctccctgtcttttgcatagacaaaaggctccagccctccagcagcccccgcttgctcccaagactcttgttgtcctgcttcaccgtccccacagtaaccaggccctgctgccgtcaatggaggcgagggggcgggagacagcagtgacgtcaaagcggaagaagggggcggggcgaagctgcctcggaatgtggggcagggaggctggagagactggagaggcagcggtttgggaggcggccagcccgagagggcggcggccagcgcacttgggaacatcatgttctcttggctggtggcccaggacatgcacccagcctgggcgcctcccccaacaaaacgacagccgtcctgtcccaaagccagggattcctggagagaggattagtaggaagggggccccctccccacacctccccccaccacgcctggctctcttttcaggactcccatctgcccgctcctcagcttgttcctgcagctctggcttttcctctctcccaaactgtacacatctgctggcctggtaccaaagacccagggcggagaagttggaggtcctgtctctgggagagaacacgacgcacctttgctaccttccagaagccccttcagagcctgaatctcttattatgacagcgggcggggggaaagggagaggggcgcggacagggaggagaaggggcctaggatgaaaaaatcaaactgggacagagcaagtggcccagtctagggcctggatcctgggagagggctagaagggaggaatgagggaatttggactgctgcctgaagaccaaaagagccaggaagagagaaatgggacgccatcaaaacttgcagaaaaacttgagaatatgagactagttcccagccacagcattcacataaatctctcaccataacccaggcattatgctaagcactttatattatcttatttcatccccagaacaaccccgtgagataggtattattatccccattccatgggggataactaaggcacggaagttactaaacttgtccagtgcctcataacatggtctcaagctcttaacaaatggagcccaggattcaaaaatctgaactctaataatggcttgtcattctggtttcttacccttgaggaacctgtgaggtgttaaccaacctgtaagctgcattccagcactggcaaacctggcctctcaaatatccagccaattctaagtttggtgccaggaacacagactccatccaacccctttctctgccttaggcctgatccgaagccactgtttgcactccccacacacttaacatcatagcccgttttcccaggctcacaaagtgcttgagatcacccaagcagccaccagccccaatgatttcctacgaagcccacttcctcacttttctactttacctcaggccaactttaccagacgcctggcctggttgtttgtacagacagataccaaaacaccctgttggtgcctccccacctctaggggctcaggaagacgtgcacagccaatctgcccaaaccccaaccctatcctctcaggactcaatagttgctaccccacgtctattctcaaggacgactctgaggcctaaacccttccgcttaacatgagaaagacgcccggagccgtaatgtgactagctctgggtctcacaaattaaaacaccatcctttctcatatcagcatgccaaccctttggtaccctccgacttgccctaccagggcctccctccggcctccgaacctctgcctctttcaagtgtttaaggagaccacccaaacaccctgggagcaggggctccttcagtcccgacctgagagggagctccctcaggtcgcagagggcttccgagcccttccccccgggcagtcaagtgtccagggactccacgggggcgagggatctgatgtcactaactcccaccccgtccctctagacctgagttcacggtccctattctccacaaccatcagagctcccaccgcagttatcacgtatttgcatgatcccacacacacacactctaacaccttcctaaccgaccacaccaccccggaaaagtccacaccgatcgccccgcatctctcccccatccccgagcactcaccgctcggcgcgcacgcacactccaaatttcttctaggacttctagcattacactggctcctccaaacccgcccacgggccgggctgccacgccccccac

SEQ ID NO: 201 - DNA, 46792 bp, Homo Sapiens
aatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactgccgtccgcgcgggcgcaccgagcccggcttggcgcgggcaacagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcagttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgcctttttttttttgcaaggtgaaggtttatagcaaggattcatcgagcaagtctgtaaatgccagccatttttccaacagcatgtgctcactttgtgtctcttgtgtcacgtttgggtaattcacaatatttcacactttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtgaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacagtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaaattagccggtcttggcagcgggcacctgtagtcccagctactcgggaggctgaggcaggagaatggtgtgaacccgggaagaggagcttgcagtgagccaagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagtttgagaccagcctgcccaacatggtgaaaccccgtctctaccaacaaaatacaaaaattagccaggcatggtggcacgctcctgtagtcccagctacttgaggagctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgagcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcagggtttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcattagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtaactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggctgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagtcaaggtgggcagatcacttgaggtcaggagttggagaccagcctggccaacatggcaaagccccatctctactaaaaatacaaaaattagccgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatccccccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctaggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcccgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcctgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcgtgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttatttatttttttgagatggagttttgctctcgttgtccagggtggagtgtaatggcatgatctcggctcctctgcctcccaggttcaagagattctcctgcctcagcctcccaagtagctggaattacaggcatccaccaccactccaggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcacctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgataggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtggcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccacgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaattcaattttttttagcaaggccatatttatactttctgcagaaagggtacactcaccagttgttttgccatgagaatacattgaataaaggagacagggttatttataacttgatgtgtttactctgctgctgtatccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttgggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgaggcagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctataacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacaaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgtcactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattggtgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtacctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccatgttagccaggatggtctcgatctcctgacctcgtgatccgcccgcctcggcctcccaaagtgctgggattataggtgtgagccaccgcgcccggccttgggtcatgatttccatcatcttagacctgttggtgctgaggttttctttaaccattggtagtctagacatcaacatgagcttcaatcatggtctgccttttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacagacatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggcctttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaata
